(12) United States Patent
Brasch et al.

(10) Patent No.: US 8,241,896 B2
(45) Date of Patent: Aug. 14, 2012

(54) COMPOSITIONS FOR USE IN RECOMBINATIONAL CLONING OF NUCELIC ACIDS

(75) Inventors: Michael Brasch, Gaithersburg, MD (US); David Cheo, Kensington, MD (US); James Hartley, Frederick, MD (US); Gary Temple, Washington Grove, MD (US)

(73) Assignee: Life Technologies Corporation, Carlsbad, CA (US)

( * ) Notice: Subject to any disclaimer, the term of this patent is extended or adjusted under 35 U.S.C. 154(b) by 0 days.

(21) Appl. No.: 12/649,129

(22) Filed: Dec. 29, 2009

(65) Prior Publication Data

US 2011/0033920 A1    Feb. 10, 2011

Related U.S. Application Data

(63) Continuation of application No. 09/517,466, filed on Mar. 2, 2000, now Pat. No. 7,670,823.

(60) Provisional application No. 60/136,784, filed on May 28, 1999, provisional application No. 60/126,049, filed on Mar. 23, 1999, provisional application No. 60/122,389, filed on Mar. 2, 1999.

(51) Int. Cl.
*C12N 15/00* (2006.01)
*C07H 21/04* (2006.01)

(52) U.S. Cl. .......... 435/320.1; 536/23.1; 536/24.32

(58) Field of Classification Search .......... None
See application file for complete search history.

(56) References Cited

U.S. PATENT DOCUMENTS

| | | |
|---|---|---|
| 4,626,505 A | 12/1986 | Falco |
| 4,673,640 A | 6/1987 | Backman |
| 4,683,195 A | 7/1987 | Mullis et al. |
| 4,683,202 A | 7/1987 | Mullis |
| 4,743,546 A | 5/1988 | Backman et al. |
| 4,808,537 A | 2/1989 | Stroman et al. |
| 4,855,231 A | 8/1989 | Stroman et al. |
| 4,959,217 A | 9/1990 | Sanders et al. |

(Continued)

FOREIGN PATENT DOCUMENTS

AU     774643     7/2004

(Continued)

OTHER PUBLICATIONS

Hartley, J.L. et al. Genome Research 10(11):1788-1795 (Nov. 2000).*

(Continued)

*Primary Examiner* — Diana Johannsen

(57) ABSTRACT

The present invention relates generally to compositions and methods for use in recombinational cloning of nucleic acid molecules. In particular, the invention relates to nucleic acid molecules encoding one or more recombination sites or portions thereof, to nucleic acid molecules comprising one or more of these recombination site nucleotide sequences and optionally comprising one or more additional physical or functional nucleotide sequences. The invention also relates to vectors comprising the nucleic acid molecules of the invention, to host cells comprising the vectors or nucleic acid molecules of the invention, to methods of producing polypeptides using the nucleic acid molecules of the invention, and to polypeptides encoded by these nucleic acid molecules or produced by the methods of the invention. The invention also relates to antibodies that bind to one or more polypeptides of the invention or epitopes thereof. The invention also relates to the use of these compositions in methods for recombinational cloning of nucleic acids, in vitro and in vivo, to provide chimeric DNA molecules that have particular characteristics and/or DNA segments.

11 Claims, 253 Drawing Sheets

U.S. PATENT DOCUMENTS

| | | | |
|---|---|---|---|
| 4,959,317 A | 9/1990 | Sauer | |
| 4,965,188 A | 10/1990 | Mullis et al. | |
| 5,093,257 A | 3/1992 | Gray | |
| 5,102,797 A | 4/1992 | Tucker et al. | |
| 5,159,062 A | 10/1992 | Knapp et al. | |
| 5,227,288 A | 7/1993 | Blattner | |
| 5,258,294 A | 11/1993 | Boyle et al. | |
| 5,286,632 A | 2/1994 | Jones | |
| 5,334,375 A | 8/1994 | Nabi et al. | |
| 5,334,575 A | 8/1994 | Noonan et al. | |
| 5,348,886 A | 9/1994 | Lee et al. | |
| 5,354,668 A | 10/1994 | Auerbach | |
| 5,378,618 A | 1/1995 | Sternberg et al. | |
| 5,434,066 A | 7/1995 | Bebee et al. | |
| 5,451,513 A | 9/1995 | Maliga et al. | |
| 5,470,727 A | 11/1995 | Mascarenhas et al. | |
| 5,527,695 A | 6/1996 | Hodges et al. | |
| 5,552,314 A | 9/1996 | Greener | |
| 5,591,609 A | 1/1997 | Auerbach | |
| 5,605,793 A | 2/1997 | Stemmer | |
| 5,614,389 A | 3/1997 | Auerbach | |
| 5,635,381 A | 6/1997 | Hooykaas et al. | |
| 5,650,308 A | 7/1997 | Baum | |
| 5,650,557 A | 7/1997 | Hannah et al. | |
| 5,654,182 A | 8/1997 | Wahl et al. | |
| 5,658,772 A | 8/1997 | Odell et al. | |
| 5,677,170 A | 10/1997 | Devine et al. | |
| 5,677,177 A | 10/1997 | Wahl et al. | |
| 5,695,971 A | 12/1997 | Kadokami et al. | |
| 5,710,248 A | 1/1998 | Grose | |
| 5,723,765 A | 3/1998 | Oliver et al. | |
| 5,728,551 A | 3/1998 | Devine et al. | |
| 5,733,733 A | 3/1998 | Auerbach | |
| 5,733,743 A | 3/1998 | Johnson et al. | |
| 5,744,336 A | 4/1998 | Hodges et al. | |
| 5,766,891 A | 6/1998 | Shuman | |
| 5,776,449 A | 7/1998 | Baum | |
| 5,801,030 A | 9/1998 | McVey et al. | |
| 5,814,300 A | 9/1998 | Scott et al. | |
| 5,830,707 A | 11/1998 | Bushman | |
| 5,837,242 A | 11/1998 | Holliger et al. | |
| 5,837,458 A | 11/1998 | Minshull et al. | |
| 5,843,772 A | 12/1998 | Devine et al. | |
| 5,851,808 A | 12/1998 | Elledge et al. | |
| 5,858,657 A | 1/1999 | Winter et al. | |
| 5,871,907 A | 2/1999 | Winter et al. | |
| 5,874,259 A | 2/1999 | Szybalski | |
| 5,888,732 A | 3/1999 | Hartley et al. | |
| 5,910,438 A | 6/1999 | Bernard et al. | |
| 5,916,804 A | 6/1999 | Bushman | |
| 5,919,676 A | 7/1999 | Graham et al. | |
| 5,928,914 A | 7/1999 | Leboulch et al. | |
| 5,929,307 A | 7/1999 | Hodges et al. | |
| 5,962,255 A | 10/1999 | Griffiths et al. | |
| 5,981,177 A | 11/1999 | Demirjian et al. | |
| 5,989,872 A | 11/1999 | Luo et al. | |
| 5,994,136 A | 11/1999 | Naldini et al. | |
| 6,010,884 A | 1/2000 | Griffiths et al. | |
| 6,025,192 A | 2/2000 | Beach et al. | |
| 6,040,138 A | 3/2000 | Lockhart et al. | |
| 6,040,430 A | 3/2000 | Stewart | |
| 6,063,627 A | 5/2000 | McVey et al. | |
| 6,066,778 A | 5/2000 | Ginsburg et al. | |
| 6,080,576 A | 6/2000 | Zambrowicz et al. | |
| 6,110,735 A | 8/2000 | Chartier et al. | |
| 6,120,764 A | 9/2000 | Graham et al. | |
| 6,121,043 A | 9/2000 | Cochran et al. | |
| 6,140,086 A | 10/2000 | Fox et al. | |
| 6,140,087 A | 10/2000 | Graham et al. | |
| 6,143,557 A | 11/2000 | Hartley et al. | |
| 6,156,497 A | 12/2000 | Kaleko | |
| 6,165,782 A | 12/2000 | Naldini et al. | |
| 6,171,861 B1 | 1/2001 | Hartley et al. | |
| 6,225,121 B1 | 5/2001 | Savakis et al. | |
| 6,228,646 B1 | 5/2001 | Hardy | |
| 6,262,341 B1 | 7/2001 | Baszczynski et al. | |
| 6,270,969 B1 | 8/2001 | Hartley et al. | |
| 6,271,436 B1 | 8/2001 | Piedrahita et al. | |
| 6,277,608 B1 | 8/2001 | Hartley et al. | |
| 6,281,000 B1 | 8/2001 | Chartier et al. | |
| 6,303,301 B1 | 10/2001 | Mack | |
| 6,309,822 B1 | 10/2001 | Fodor et al. | |
| 6,333,155 B1 | 12/2001 | Lockhart et al. | |
| 6,361,972 B1 | 3/2002 | Harrington et al. | |
| 6,365,377 B1 | 4/2002 | Patten et al. | |
| 6,410,266 B1 | 6/2002 | Harrington et al. | |
| 6,410,317 B1 | 6/2002 | Farmer | |
| 6,436,707 B1 | 8/2002 | Zambrowicz et al. | |
| 6,544,790 B1 | 4/2003 | Sabatini | |
| 6,576,463 B1 | 6/2003 | Kasahara et al. | |
| 6,720,140 B1 | 4/2004 | Hartley et al. | |
| 6,884,612 B2 | 4/2005 | Maruyama et al. | |
| 6,964,861 B1 | 11/2005 | Gerard et al. | |
| 7,176,029 B2 | 2/2007 | Bernard et al. | |
| 7,223,576 B2 | 5/2007 | Hartley et al. | |
| 7,282,326 B2 | 10/2007 | Hartley et al. | |
| 7,304,130 B2 | 12/2007 | Hartley et al. | |
| 7,351,578 B2 | 4/2008 | Cheo et al. | |
| 7,393,632 B2 | 7/2008 | Cheo et al. | |
| 7,408,049 B2 | 8/2008 | Hartley et al. | |
| 7,670,823 B1 | 3/2010 | Brasch et al. | |
| 2002/0006664 A1 | 1/2002 | Sabatini | |
| 2002/0007051 A1 | 1/2002 | Cheo et al. | |
| 2002/0068290 A1 | 6/2002 | Yarovinsky | |
| 2002/0094574 A1 | 7/2002 | Hartley et al. | |
| 2002/0106797 A1 | 8/2002 | Miles et al. | |
| 2002/0162126 A1 | 10/2002 | Beach et al. | |
| 2002/0172997 A1 | 11/2002 | Hartley et al. | |
| 2002/0182731 A1 | 12/2002 | Ji et al. | |
| 2002/0192819 A1 | 12/2002 | Hartley et al. | |
| 2003/0022179 A1 | 1/2003 | Chesnut | |
| 2003/0027289 A1 | 2/2003 | Farmer | |
| 2003/0027337 A1 | 2/2003 | Droge et al. | |
| 2003/0032203 A1 | 2/2003 | Sabatini et al. | |
| 2003/0054552 A1 | 3/2003 | Hartley et al. | |
| 2003/0054555 A1 | 3/2003 | Farmer et al. | |
| 2003/0059900 A1 | 3/2003 | Farmer | |
| 2003/0064515 A1 | 4/2003 | Hartley et al. | |
| 2003/0068799 A1 | 4/2003 | Hartley et al. | |
| 2003/0077804 A1 | 4/2003 | Byrd et al. | |
| 2003/0100110 A1 | 5/2003 | Hartley et al. | |
| 2003/0102346 A1 | 6/2003 | Chen | |
| 2003/0124555 A1 | 7/2003 | Brasch et al. | |
| 2003/0135888 A1 | 7/2003 | Zhu et al. | |
| 2003/0153055 A1 | 8/2003 | Miles et al. | |
| 2003/0157662 A1 | 8/2003 | Gerard et al. | |
| 2003/0157716 A1 | 8/2003 | Hartley et al. | |
| 2003/0175772 A1 | 9/2003 | Wang | |
| 2003/0175970 A1 | 9/2003 | Hartley et al. | |
| 2003/0176644 A1 | 9/2003 | Byrd et al. | |
| 2003/0186233 A1 | 10/2003 | Chesnut et al. | |
| 2003/0203486 A1 | 10/2003 | Sabatini | |
| 2003/0220249 A1 | 11/2003 | Hackett et al. | |
| 2004/0040053 A1 | 2/2004 | Nomura et al. | |
| 2004/0053412 A1 | 3/2004 | Hartley et al. | |
| 2004/0063207 A1 | 4/2004 | Hartley et al. | |
| 2004/0132133 A1 | 7/2004 | Bennett | |
| 2004/0171156 A1 | 9/2004 | Hartley et al. | |
| 2004/0171157 A1 | 9/2004 | Hartley et al. | |
| 2004/0219516 A1 | 11/2004 | Bennett et al. | |
| 2004/0219673 A1 | 11/2004 | Hartley et al. | |
| 2004/0229229 A1 | 11/2004 | Cheo et al. | |
| 2004/0253620 A1 | 12/2004 | Leong et al. | |
| 2004/0253631 A1 | 12/2004 | Hartley et al. | |
| 2004/0265863 A1 | 12/2004 | Chesnut et al. | |
| 2005/0009091 A1 | 1/2005 | Hartley et al. | |
| 2005/0069929 A1 | 3/2005 | Chestnut et al. | |
| 2005/0095615 A1 | 5/2005 | Welch et al. | |
| 2005/0176065 A1 | 8/2005 | Hanson | |
| 2005/0181417 A1 | 8/2005 | Miles et al. | |
| 2005/0208530 A1 | 9/2005 | Chesnut et al. | |
| 2006/0008817 A1 | 1/2006 | Carrino et al. | |
| 2006/0035269 A1 | 2/2006 | Hartley et al. | |
| 2006/0073593 A1 | 4/2006 | Byrd et al. | |
| 2006/0204979 A1 | 9/2006 | Gray et al. | |
| 2007/0128725 A1 | 6/2007 | Brasch et al. | |
| 2007/0184451 A1 | 8/2007 | Byrd et al. | |

FOREIGN PATENT DOCUMENTS

| | | |
|---|---|---|
| CA | 2141412 | 2/1994 |
| EP | 0160571 | 6/1985 |
| EP | 0220009 | 4/1987 |
| EP | 0300422 | 1/1989 |
| EP | 0427074 | 5/1991 |
| EP | 0542466 | 5/1993 |
| EP | 1035208 | 9/2000 |
| EP | 1173460 | 1/2002 |
| EP | 0937098 | 8/2002 |
| EP | 1227147 | 8/2002 |
| JP | 4580106 | 9/2010 |
| WO | WO90/11375 | 10/1990 |
| WO | WO91/02801 | 3/1991 |
| WO | WO91/09957 | 4/1991 |
| WO | WO91/16427 | 10/1991 |
| WO | WO92/15694 | 9/1992 |
| WO | WO92/20791 | 11/1992 |
| WO | WO92/22650 | 12/1992 |
| WO | WO93/15191 | 8/1993 |
| WO | WO93/19172 | 9/1993 |
| WO | WO94/03624 | 2/1994 |
| WO | WO94/09127 | 4/1994 |
| WO | WO94/17176 | 8/1994 |
| WO | WO94/18333 | 8/1994 |
| WO | WO94/20604 | 9/1994 |
| WO | WO95/00555 | 1/1995 |
| WO | WO96/04393 | 2/1996 |
| WO | WO96/19497 | 6/1996 |
| WO | WO96/23904 | 8/1996 |
| WO | WO96/30498 | 10/1996 |
| WO | WO96/40722 | 12/1996 |
| WO | WO96/40724 | 12/1996 |
| WO | WO97/06265 | 2/1997 |
| WO | WO97/09436 | 3/1997 |
| WO | WO97/25446 | 7/1997 |
| WO | WO97/32481 | 9/1997 |
| WO | WO97/47758 | 12/1997 |
| WO | WO98/10086 | 3/1998 |
| WO | WO98/38326 | 9/1998 |
| WO | WO98/53009 | 11/1998 |
| WO | WO99/10488 | 3/1999 |
| WO | WO99/21977 | 5/1999 |
| WO | WO99/25851 | 5/1999 |
| WO | WO99/55851 | 11/1999 |
| WO | WO00/12687 | 3/2000 |
| WO | WO00/29000 | 5/2000 |
| WO | WO00/52027 | 9/2000 |
| WO | WO00/52141 | 9/2000 |
| WO | WO00/60091 | 10/2000 |
| WO | WO01/05961 | 1/2001 |
| WO | WO01/07572 | 2/2001 |
| WO | WO01/11058 | 2/2001 |
| WO | WO01/20015 | 3/2001 |
| WO | WO01/25466 | 4/2001 |
| WO | WO01/31039 | 5/2001 |
| WO | WO01/42509 | 6/2001 |
| WO | WO01/62892 | 8/2001 |
| WO | WO01/68836 | 9/2001 |
| WO | WO02/00875 | 1/2002 |
| WO | WO02/05294 | 1/2002 |
| WO | WO02/08391 | 1/2002 |
| WO | WO02/16594 | 2/2002 |
| WO | WO02/46972 | 6/2002 |
| WO | WO02/061034 | 8/2002 |
| WO | WO02/062957 | 8/2002 |
| WO | WO 02066657 A1 * | 8/2002 |
| WO | WO02/077264 | 10/2002 |
| WO | WO02/086144 | 10/2002 |
| WO | WO02/095055 | 11/2002 |
| WO | WO03/025161 | 3/2003 |
| WO | WO03/044207 | 5/2003 |
| WO | WO03/103600 | 12/2003 |
| WO | WO2004/009768 | 1/2004 |
| WO | WO2004/013290 | 2/2004 |
| WO | WO2005/012487 | 2/2005 |
| WO | WO2005/014796 | 2/2005 |

OTHER PUBLICATIONS

Bernard, P. et al. Mol Gen Genet 226:297-304 (1991).*
Abremski et al., Bacteriophage P1 Cre-loxP site-specific DNA Topoisomerase Activity of the Cre Recombination Protein, *The Journal of Biological Chemistry*, vol. 261, No. 1, Jan. 5, 1986, 391-396.
Abremski et al., "Bacteriophage P1 Site-specific Recombination-Purification and Properties of the Cre Recombinase Protein", *The Journal of Biological Chemistry*, vol. 256, No. 3, Feb. 10, 1984, 1509-1514.
Abremski et al., "Purification of the Bacteriophage lamda xis Gene Product Required for lamda Excisive Recombination", *The Journal of Biological Chemisty*, vol. 256, No. 16, Aug. 25, 1982, 9658-9662.
Abremski et al., "Studies on the Properties of P1 Site-Specific Recombination: Evidence for Topologically Unlinked Products Following Recombination", *Cell*, vol. 32, Apr. 1993, 1301-1311.
Adams et al., "Cre-lox Recombination in *Escherichia coli* Cells: Mechanistic Differences from the in Vitro Reaction", *Journal of Molecular Biology*, vol. 226, 1992, 661-673.
Agah et al., "Gene Recombination in Postmitotic Cells. Targeted Expression of Cre Recombinase Provokes Cardiac-restricted, Site-specific Rearrangement in Adult Ventricular Muscle In Vivo", *The Journal of Clinical Investigation*, vol. 100, No. 1, Jul. 1997, 169-179.
Akagi et al., "Cre-mediated somatic site-specific recombination in mice", *Nucleic Acids Research*, vol. 25, No. 9, May 1, 1997, 1766-1773.
Aladjem et al., "Positive Selection of FLP-Mediated Unequal Sister Chromatid Exchange Products in Mammalian Cells", *Molecular and Cellular Biology*, vol. 17, No. 2, Feb. 1997, 857-861.
Albert et al., "Site-specific integration of DNA into wild-type and mutant lox sites placed in the plant genome", *The Plant Journal*, vol. 7, No. 4, 1995, 649-659.
Alonso, "Site-specific recombination in Gram-positive theta-replicating plasmids", *FEMS Microbiology Letters*, vol. 142, Aug. 1996, 1-10.
Amin et al., "Synthesis of an Enzymatically Active FLP Recombinase In Vitro: Search for a DNA-Binding Domain", *Molecular and Cellular Biology*, vol. 9, No. 5, May 1989, 1987-1995.
Andrews et al., "Interaction of the FLP Recombinase of the *Saccharomyces cerevisiae* 2mum Plasmid with Mutated Target Sequences", *Molecular and Cellular Biology*, vol. 6, No. 7, Jul. 1986, 2482-2489.
Andrews et al., "The FLP Recombinase of the 2.mu. Circle DNA of Yeast: Interaction with Its Target Sequences", *Cell*, vol. 40, Apr. 1985, 795-803.
Angelastro et al., "Identification of diverse nerve growth factor-regulated genes by serial analysis of gene expression (SAGE) profiling", *Proceedings of the National Academy of Sciences*, vol. 97, No. 19, Sep. 12, 2000, 10424-10429.
Angrand et al., "Inducible expression based on regulated recombination: a single vector strategy for stable expression in cultured cells", *Nucleic Acids Research*, vol. 26, No. 13, 1998, 3263-3269.
Anton et al., "Site-Specific Recombination Mediated by an Adenovirus Vector Expressing the Cre Recombinase Protein: A Molecular Switch for Control of Gene Expression", *Journal of Virology*, vol. 69, No. 8, Aug. 1995, 4600-4606.
Aoki et al., "Efficient Generation of Recombinant Adenoviral Vectors by Cre-lox Recombination in Vitro", *Molecular Medicine*, vol. 5, 1999, 224-231.
Araki, et al., "Site-specific Recombinase, R, Encoded by Yeast Plasmid pSR1", *Journal of Molecular Biology*, vol. 225, No. 1, May 5, 1992, 25-37.
Argos et al., "The integrase family of site-specific recombinases: regional similarities and global diversity", *The EMBO Journal*, vol. 5, No. 5, 1986, 433-440.
Astumian et al., "Site-specific recombination between cloned attp and attB sites from the *Haemophilus influenza* bacteriophage HP1 propagated in recombination deficient *Escherichia coli*", *Journal of Bacteriology*, vol. 171, No. 3, Mar. 1989, 1747-1750.
Atlung et al., "A versatile method for integration of genes and gene fusions into the lambda attachment site of *Escherichia coli*", *Gene*, vol. 107, 1991, 11-17.
Ausubel et al., "Mutagenesis by the Polymerase Chain Reaction", *Current Protocols in Molecular Biology*, John Wiley & Sons, Inc., Boston, MA, 1995, 8.5.1-8.5.9.

Ausubel et al., "Maps of Plasmids pBR322 and pUC19", *Current Protocols in Molecular Biology*, John Wiley & Sons, Inc., Boston, MA, 1995, 1.5.3-1.5.4.

Ayres et al., "Precise Deletions in Large Bacterial Genomes by Vector-mediated Excision (VEX). The trfA Gene of Promiscuous Plasmid RK2 is Essential for Replication in Several Gram-negative Hosts", *Journal of Molecular Biology*, vol. 230, 1993, 174-185.

Babineau et al., "The FLP Protein of the 2-micron Plasmid of Yeast", *The Journal of Biological Chemistry*, vol. 260, No. 22, Oct. 5, 1985, 12313-12319.

Backman et al., "Use of Synchronous Site-Specific Recombination In Vivo to Regulate Gene Expression", *Bio/Technology*, vol. 2, No. 12, Dec. 1984, 1045-1049.

Bai et al., "SKP1 Connects Cell Cycle Regulators to the Ubiquitin Proteolysis Machinery through a Novel Motif, the F-Box", *Cell*, vol. 86, Jul. 26, 1996, 263-274.

Balakrishnan et al., "A gene cassette for adapting *Escherichia coli* strains as hosts for att-Int-mediated rearrangement and P1 expression vectors", *Gene*, vol. 138, Jan. 1994, 101-104.

Ball et al., "Efficient Excision of Phage Lambda from the *Escherichia coli* Chromosome Requires the Fis Protein", *Journal of Bacteriology*, Jul. 1991, vol. 173, No. 13, 4027-4031.

Barnes et al., "Regulated expression of endonuclease EcoRI in *Saccharomyces cerevisiae*: Nuclear entry and biological consequences", *Proceedings of the National Academy of Sciences*, vol. 82, Mar. 1985, 1354-1358.

Baubonis et al., "Genomic targeting with purified Cre recombinase.", *Nucleic Acids Research*, vol. 21. No. 9, 1993, 2025-2029.

Bauer et al., "Extent of Sequence Homology Required for Bacteriophage Lambda Site-specific Recombination", *Journal of Molecular Biology*, vol. 181, 1985, 187-197.

Baum, "Tn5401, a New Class II Transposable Element From *Bacillus thuringiensis*", *Journal of Bacteriology*, vol. 176, No. 10, May 1994, 2835-2845.

Bayley et al., "Exchange of gene activity in transgenic plants catalyzed by the Cre-lox site specific recombination system", *Plant Molecular Biology*, vol. 18, 1992, 353-361.

Benoist et al., "In vivo sequence requirements of the SV40 early promoter region", *Nature*, vol. 290, Mar. 26, 1981, 304-310.

Bernard et al., "Cell Killing by the F plasmid Ccdb Protein Involves Poisoning of DNA-topoisomerase II Complexes", *J. Mol. Biol.*, vol. 226, Academic Press, Inc., 1992, 735-745.

Bernard, "Positive Selection of Recombinant DNA by CcdB", *BioTechniques*, vol. 21, No. 2, Aug. 1996, 320-323.

Bernard et al., "Positive-selection vectors using the F plasmid ccdB killer gene", *Gene*, vol. 148, Oct. 1994, 71-74.

Bernard et al., "The F Plasmid CcdB Protein Induces Efficient ATP-dependent DNA Cleavage by Gyrase", *Journal of Molecular Biology*, vol. 234, 1993, 534-541.

Bethke et al., "Segmental genomic replacement by Cre-mediated recombination: genotoxic stress activation of the p53 promoter in single-copy transformants", *Nucleic Acids Research*, vol. 25, No. 14, 1997, 2828-2834.

Betz et al., "Bypass of lethality with mosaic mice generated by Cre-loxP-mediated recombination", *Current Biology Ltd.*, vol. 6, No. 10, Oct. 1996, 1307-1316.

Bhandari, et al., "An *Escherichia Coli* Host Strain Useful for Efficient Overproduction of Cloned Gene Products with NaCl as the Inducer", *Journal of Bacteriology*, vol. 179, No. 13, Jul. 1997, 4403-4406.

Black, "In vitro packaging into phage T4 particles and specific recircularization of phage lambda DNAs", *Gene*, vol. 46, 1986, 97-101.

Bliska et al., "Use of Site-Specific Recombination as a Probe of DNA Structure and Metabolism in Vivo", *Journal of Molecular Biology*, vol. 194, 1987, 205-218.

Bloch et al., "Purification of *Escherichia coli* Chromosomal Segments without Cloning", *Biochemical and Biophysical Research Communications*, vol. 223, Jun. 1996, 104-111.

Bochner et al., "Positive Selection for Loss of Tetracycline Resistance", *Journal of Bacteriology*, vol. 143, No. 2, Aug. 1980, 926-933.

Boshart et al., "A Very Strong Enhancer is Located Upstream of an Immediate Early Gene of Human Cytomegalovirus", *Cell*, vol. 41, Jun. 1985, 521-530.

Botstein et al.,"Making Mutations In Vitro and Putting Them Back Into Yeast", *Miami Winter Symposia*, From Gene To Protein: Translation into Biotechnology, Ahmad, F., et al., eds., Academic Press, New York, NY, vol. 19, 1982, 265-274.

Bouhassira et al., "Transcriptional Behavior of LCR Enhancer Elements Integrated at the Same Chromosomal Locus by Recombinase-Mediated Cassette Exchange", *Blood*, vol. 90, No. 9, Nov. 1, 1997, 3332-3344.

Boyd et al., "Turbo cloning: a fast, efficient method for cloning PCR products and other blunt-ended DNA fragments into plasmids", *Nucleic Acids Research*, vol. 21, No. 4, 1993, 817-821.

Brent et al., "A bacterial repressor protein or a yeast transcriptional terminator can block upstream activation of a yeast gene", *Nature*, vol. 312, Dec. 13, 1984, 612-615.

Broach et al., "Recombination within the Yeast Plasmid, 2 mu Circle is Site Specific", *Cell*, vol. 29, May 1982, 227-234.

Broach, "The Yeast Plasmid 2μ Circle", *Cell*, vol. 28, 1982, 203-204.

Bruckner et al., "The Histone-like H Protein of *Escherichia coli* is ribosomal protein S3", *Nucleic Acids Research*, vol. 17, No. 8, 1989, 3145-3161.

Brunelli et al., "Lambda/plasmid vector construction by in vivo", *BioTechniques*, vol. 16, No. 6, Jun. 2004, pp. 1060-1064.

Brunelli et al., "A Series of Yeast/*Escherichia coli* lamda Expression Vectors Designed for Directional Cloning of cDNAs and cre/lox-Mediated Plasmid Excision", *Yeast*, vol. 9, 1993, 1309-1318.

Bubeck et al., "Rapid cloning by homologous recombination in vivo", *Nucleic Acids Research*, vol. 21, No. 15, 1993, 3601-3602.

Buchholz et al., "A simple assay to determine the functionality of Cre or FLP recombination targets in genomic manipulation constructs", *Nucleic Acids Research*, vol. 24, No. 15, Aug. 1996, 3118-3119.

Buchholz et al., "Different thermostabilities of FLP and Cre recombinases: implications for applied site-specific recombination", *Nucleic Acids Research*, vol. 24, No. 21, 1996, 4256-4262.

Burioni et al., "An improved phage display vector for antibody repertoire cloning by construction of combinatorial libraries", *Res. Virol.*, vol. 148, Elsevier, Mar.-Apr., 1997, 161-164.

Bushman et al., "Control of Directionality in Lambda Site Specific Recombination", *Science*, vol. 230, 1985, 906-911.

Campbell, "Comparative Molecular Biology of Lambdoid Phages", *Annual Review of Microbiology*, vol. 48, 1994, 193-222.

Campbell, "Chromosomal insertion sites for phages and plasmids", *Journal of Bacteriology*, vol. 174, No. 23, Dec. 1992, 7495-7499.

Capone et al., "Introduction of UAG, UAA, and UGA Nonsense Mutations at a Specific Site in the *Escherichia coli* Chloramphenicol Acetyltransferase Gene: Use in Measurement of Amber, Ochre, and Opal Suppression in Mammalian Cells", *Molecular and Cellular Biology*, vol. 6, No. 9, Sep. 1986, 3059-3067.

Carninci et al., "High-Efficiency Full-Length cDNA Cloning", *Methods in Enzymology*, vol. 303, 1999, 19-44.

Cenatiempo, "Prokaryotic gene expression in vitro: transcription-translation coupled systems", *Biochimie*, vol. 68, 1986, 505-515.

Chanock et al., "Human Monoclonal Antibody Fab Fragments Cloned from Combinatorial Libraries: Potential Usefulness in Prevention and/or Treatment of Major Human Viral Diseases", *Infectious Agents and Disease*, vol. 2, 1993, 118-131.

Chapin et al., "Differential expression of alternatively spliced forms of MAP4: a repertoire of structurally different microtubule-binding domains", *Biochemistry*, vol. 34, Feb. 1995, 2289-2301.

Chatterjee et al., "Isolating large nested deletions in bacterial and P1 artificial chromosomes by in vivo P1 packaging of products of Cre-catalyzed recombination between the endogenous and a transposed loxP site", *Nucleic Acids Research*, vol. 25, No. 11, Jun. 1997, 2205-2212.

Chatterjee et al., "Retrofitting High Molecular Weight DNA Cloned in P1: Introduction of Reporter Genes, Markers Selectable in Mammalian Cells and Generation of Nested Deletions", *Genetic Analysis: Biomolecular Engineering*, vol. 13, Jul. 1996, 33-42.

Cherepanov et al., "Gene distribution in *Escherichia Coli*: Tc and Km Cassetees with the Option of Flp-Catalyzed Excision of the Antibiotic-Resistance Determinant", *Gene*, vol. 158, Elsevier Science B.V., 1995, 9-14.

Chong et al., "Single-column purification of free recombinant proteins using a self-cleavable affinity tag derived from a protein splicing element", *Gene*, vol. 192, 1997, 271-281.

Choulika et al., "Transfer of Single Gene-Containing Long Terminal Repeats into the Genome of Mammalian Cells by a Retroviral Vector Carrying the cre Gene and the loxP site", *Journal of Virology*, vol. 70, No. 3, Mar. 1996, 1792-1798.

Christiansen et al., "A Resolvase-Like Protein Is Required for the Site-Specific Integration of the Temperate Lactococcal Bacteriophage TP901-1", *Journal of Bacteriology*, vol. 178, No. 17,.Sep. 1996, 5164-5173 .

Chuang et al., "Specific and heritable genetic interference by double-stranded RNA in *Arabidopsis thaliana*", *Proceedings of the National Academy of Sciences*, vol. 97, No. 9, Apr. 25, 2000, 4985-4990.

Cigan et al., "Mutational Analysis of the HIS4 Translational Initiator Region in *Saccharomyces cerevisiae*", *Molecular and Cellular Biology*, vol. 8, No. 7, Jul. 1988, 2964-2975.

CLONTECH, "Creator Acceptor Vector Construction Kits", *CLONTECHniques*, Oct. 2001, 2.

CLONTECH, "Creator Gene Cloning & Expression System", *CLONTECHniques*, Apr. 2000, 7-11.

CLONTECH, "Creator pDNR-Dual Cloning Kit", *CLONTECHniques*, Oct. 2001, 1-3.

CLONTECH, "Creator SMART Library Construction Kit", *CLONTECHniques16*, Oct. 2001, 1-2.

CLONTECH, Presentation, "Creator: The Universal Platform for Analysis of Gene Function", *Powerpoint Presentation*, available at http://www.clontech.com/products/families/creator/popups/s1page1.html, Jul. 24, 2001, 1-9.

CLONTECH, "New Additions to the Creator Platform", http://www.clontech.com/archive/JAN01UPD/creator.shtml, Jan. 2001, 1-4.

CLONTECH, "New Creator-Compatible Expression Systems", *CLONTECHniques*, Oct. 2000, 1-2.

CN Application No. 00818077.6, Final Office Action mailed on Feb. 6, 2009.

Collis, Christina M. et al., "Expression of Antibiotic Resistance Genes in the Integrated Cassettes of Integrons", *Antimocrobial Agents and Chemotherapy*, vol. 39, No. 1, Jan. 1995, 155-162.

Cormack, "Directed Mutagenesis Using the Polymerase Chain Reaction", *Current Protocols in Molecular Biology*, Ausubel, F.M., et al., eds., John Wiley & Sons, Inc., Boston, MA, 1997, 8.5.1-8.5.10.

Cox, "The FLP protein of the yeast 2-.micrometer plasmid: Expression of a eukaryotic genetic recombination system in *Escherichia coli*", *Proceedings of the National Academy of Sciences*, vol. 80, Jul. 1983, 4223-4227.

Craig et al., "The Mechanism of Phage lambda Site-Specific Recombination: Site-Specific Breakage of DNA by Int Topoisomerase", *Cell*, vol. 35, Dec. 1983, 795-803.

Crellin et al., "The Resolvase/Invertase Domain of Site-Specific Recombinase TnpX Is Functional and Recognizes a Target Sequence That Resembles the Junction of the Circular Form of the *Clostridium perfringens* Transposon Tn4451", *Journal of Bacteriology*, vol. 179, No. 16, Aug. 16, 1997, 5148-5156.

Csordas-Toth et al., "Nucleotide sequence of a secondary attachment site for bacteriophage lambda on the *Escherichia coli* chromosome", *Nucleic Acids Research*, vol. 7, No. 5, 1979, 1335-1341.

Curcio et al., "Single-step selection for Ty1 element retrotransposition", *Proceedings of the National Academy of Sciences*, vol. 88, Feb. 1991, 936-940.

Dale et al., "Gene transfer with subsequent removal of the selection gene from the host genome", *Proceedings of the National Academy of Sciences*, vol. 88, Dec. 1991, 10558-10562.

Dale et al., "Intra- and intermolecular site-specific recombination in plant cells mediated by bacteriophage P1 recombinase", *Gene*, vol. 91, 1990, 79-85.

Dang et al., "Use of a Yeast Site-Specific Recombinase to Generate Embryonic Mosaics in Drosophila", *Developmental Genetics*, vol. 13, 1992, 367-375.

Datson et al., "MicroSAGE: a modified procedure for serial analysis of gene expression in limited amounts of tissue", *Nucleic Acids Research*, vol. 27, No. 5, 1999, 1300-1307.

Davies et al., "An Antibody VH Domain with a lox-Cre Integrated Into its Coding Region: Bacterial Recombination within a Single Polypeptide Chain", *FEBS Letters*, vol. 377, 1995, 92-96.

Davis et al., "Analysis of the Mechanisms of Action of the *Saccharomyces cerevisiae* Dominant Lethal cdc42 G12V and Dominant Negative cdc42 D118A Mutations", *The Journal of Biological Chemistry*, vol. 273, No. 2, Jan. 9, 1998, 849-858.

Degryse, "In vivo intermolecular recombination in *Escherichia coli*: application to plasmid constructions", *Gene*, vol. 170, 1996, 45-50.

Deng et al., "Ethanol Synthesis by Genetic Engineering in Cyanobacteria", *Applied and Environmental Microbiology*, vol. 65, No. 2, Feb. 1999, 523-528.

Derbyshire et al., "Lightning strikes twice: Intron-intein coincidence", *Proceedings of the National Academy of Sciences*, vol. 95, Feb. 1998, 1356-1357.

Devine et al., "Efficient integration of artificial transposons into plasmid targets in vitro: a useful tool for DNA mapping, sequencing and genetic analysis", *Nucleic Acids Research*, vol. 22, No. 18, 1994, 3765-3772.

Diederich et al., "New Cloning vectors for Integration into the Lambda Attachment Site attB of the *Escherichia coli* Chromosome", *Plasmid*, vol. 28, 1992, 14-24.

Dijkema et al., "Cloning and expression of the chromosomal immune interferon gene of the rat", *The EMBO Journal*, vol. 4, No. 3, 1985, 761-767.

Dymecki, "A modular set of Flp, FRT and lacZ fusion vectors for manipulating genes by site-specific recombination", *Gene*, vol. 171, 1996, 197-201.

Edlund et al., "Tandem Duplication Induced by an Unusual ampA1-, ampC-Transducing Lambda Phage: A Probe to Initiate Gene Amplification", *Molecular and General Genetics*, vol. 180, 1980, 249-257

Elledge et al., "Lamda YES: A multifunctional cDNA expression vector for the isolation of genes by complementation of yeast and *Escherichia coli* mutations", *Proceedings of the National Academy of Sciences*, vol. 88, Mar. 1991, 1731-1735.

Enquist et al., "Strand exchange in site-specific recombination", *Proceedings of the Academy of Sciences*, vol. 76, No. 3, Mar. 1979, 1363-1367.

Enquist et al., "The Red Plaque Test: A Rapid Method for Identification of Excision Defective Variants of Bacteriophage Lambda", *Virology*, vol. 72, No. 1, Jul. 1, 1976, 147-153.

EP Application No. 08153538.7, European Search Report mailed Jan. 16, 2009.

EP Application No. 98955110.6, European Search report mailed on Sep. 17, 2002.

EP Application No. 98955110.6, European Search Report mailed on Jun. 11, 2002.

EP Application No. 02001134.2, European Search Report mailed Jun. 10, 2002.

EP Application No. 00914799.2, European Search Report mailed Mar. 26, 2004.

EP Application No. 02001135.9, European Search Report mailed Jun. 11, 2002.

EP Application No. 02001135.9, Extended European Search Report mailed Sep. 16, 2002.

Esposito et al., "The integrase family of tyrosine recombinases: evolution of a conserved active site domain", *Nucleic Acids Research*, vol. 25, No. 18, 1997, 3605-3614.

Feil et al., "Regulation of Cre Recombinase Activity by Mutated Estrogen Receptor Ligand-Binding Domains", *Biochemical and Biophysical Research Communications*, vol. 237, 1997, 752-757.

Feinbaum, "Vectors Derived from Plasmids", *Current Protocols in Molecular Biology*, John Wiley & Sons, Inc., Boston, MA, 1998, 1:1.5.1-1.5.17.

Ferguson et al., "Construction and characterization of three yeast-*Escherichia coli* shuttle vectors designed for rapid subcloning of yeast genes on small DNA fragments", *Gene*, vol. 16, 1981, 191-197.

Ferrin et al., "Sequence-specific ligation of DNA using RecA protein", *Proceedings of the National Academy of Sciences*, vol. 95, Mar. 1998, 2152-2157.

Fiering et al., "An "in-out" strategy using gene targeting and FLP recombinase for the functional dissection of complex DNA regulatory elements: Analysis of the Beta-globin locus control region", *Proceedings of the National Academy of Sciences*, vol. 90, Sep. 1993, 8469-8473.

Filutowicz et al., "Purification of the *Escherichia coli* integration host factor (IHF) in one chromatographic step", *Gene*, vol. 147, 1994, 149-150.

Flanagan et al., "Analysis of Inhibitors of the Site-specific Recombination Reaction Mediated by TN3 Resolvase", *Journal of Molecular Biology*, vol. 206, 1989, 295-304.

Flores, A. et al., "A protein-protein interaction map of yeast RNA polymerase III", *Proceedings of the National Academy of Sciences*, vol. 96, Biochemistry, Jul. 1999, 7815-7820.

FR Application No. 2670502, Dialog File 351, English Language Abstract, *Derwent World Patent Index*, French Patent No. FR 2 670 502 (Document AL20) and PCT Patent No. WO 92/10577 (Document AM20), WPI Accession No. 9107201, 1992.

Francia et al., "Gene Integration in the *Escherichia coli* Chromosome Mediated by Tn21 Integrase (Int21)", *Journal of Bacteriology*, vol. 178, No. 3, Feb. 1996, 894-898.

Francia et al., "The Intl1 Integron Integrase Preferentially Binds Single-Stranded DNA of the attC Site", *Journal of Bacteriology*, vol. 181, No. 21, Nov. 1999, 6844-6849.

Fukushige et al., "Genomic targeting with a positive-selection lox integration vector allows highly reproducible gene expression in mammalian cells", *Proceedings of the National Academy of Sciences*, vol. 89, Sep. 1992, 7905-7909.

Gage et al., "A Cell-Free Recombination System for Site-Specific Integration of Multigenic Shuttle Plasmids into Herpes Simplex Type 1 Genome", *Journal of Virology*, vol. 66, No. 9, Sep. 1992, 5509-5515.

Gardner et al., "Role of *Escherichia coli* IHF Protein in Lambda Site-specific Recombination—A Mutational Analysis of Binding Sites", *Journal of Molecular Biology*, vol. 19, No. 2, Sep. 20, 1986, 181-189.

Gay et al., "Positive Selection Procedure for Entrapment of Insertion Sequence Elements in Gram-Negative Bacteria", *Journal of Bacteriology*, vol 164, No. 2, Nov. 1985, 918-921.

Gay et al., "Cloning Structural Gene sacB, Which Codes for Exoenzyme Levansucrase for *Bacillus subtilis*: Expression of the Gene in *Escherichia coli*", *Journal of Bacteriology*, vol. 153, No. 3, Mar. 1983, 1424-1431.

Geoffroy et al., "A new phage display system to construct multicombinatorial libraries of very large antibody repertoires", *Gene*, vol. 151, 1994, 109-113.

Gibco BRL, GatewayTM Cloning Technology, Version 1, Life Technologies Instructions Manual, http://www.lifetech.com/gateway, 1999, 1-60.

Glasgow et al., "DNA-binding Properties of the Hin Recombinase*", *The Journal of Biological Chemistry*, vol. 264, No. 17, Jun. 15, 1989, 10072-10082.

Golic et al., "The FLP Recombinase of Yeast Catalyzes Site-Specific Recombination in the *Drosophila* Genome", *Cell*, vol. 59, No. 3, Nov. 3, 1999, 499-509.

Golic et al., "Engineering the *Drosophila* Genome: Chromosome Rearrangements by Design", *Genetics*, vol. 144, Dec. 1996, 1693-1711.

Gorman et al., "The Rous sarcoma virus long terminal repeat is a strong promotor when Introduced into a variety of eukaryotic cells by DNA-mediated transfection", *Proceedings of the National Academy of Sciences*, vol. 79, Nov. 1982, 6777-6781.

Gotou et al., "Gateway Cloning Technology", *Experimental Medicine*, vol. 18, No. 19, Dec. 2000, 2716-2717.

Gottesman et al., "Bacterial Regulation: Global Regulatory Networks", *Annual Review of Genetics*, vol. 18, 1984, 415-441.

Gotz et al., "*Escherichia coli* 30S mutants lacking protein S20 are defective in translation initiation", *Biochemica et Biophysica Acta*, vol. 1050, 1990, 93-97.

Green et al., "Ribosomes and Translation", Annu. Rev. Biochem, vol. 66, 1997, 679-716.

Grindley et al., "Effects of Different Alleles of the *E. coli* K12 polA Gene on the Replication of Non-transferring Plasmids", *Molecular and General Genetics*, vol. 143, 1976, 311-318.

Gronostajski et al., "The FLP Protein of the 2-micron Plasmid of Yeast. Inter- and Intramolecular Reactions", *The Journal of Biological Chemistry*, vol. 260, No. 22, Oct. 5, 1985, 12328-12335.

Gu et al., "Deletion of a DNA Polymerase Beta Gene Segment in T Cells Using Cell Type-Specific Gene Targeting", *Science*, vol. 265, No. 5168, Jul. 1, 1994, 103-106.

C147 Guo et al., "Asymmetric DNA bending in the Cre-loxP site-specific recombination synapse", *Proceedings of the National Academy of Sciences*, vol. 96, Jun. 1999, 7143-7148.

Guo et al., "Structure of Cre recombinase complexed with DNA in a site-specific recombination synapse", *Nature*, vol. 389, Sep. 4, 1997, 40-46.

Haffter et al., "Enhancer-independent mutants of the Cin recombinase have a relaxed topological specificity", *The EMBO Journal*, vol. 7, No. 12, 1988, 3991-3996.

Hall et al., "Mobile Gene Cassettes and Integrons: Capture and Spread of Genes by Site-specific Recombination", *Molecular Microbiology*, vol. 15, 1995, 593-600.

Hallet et al., "Transposition and site-specific recombination: adapting DNA cut-and-paste mechanisms to a variety of genetic rearrangements", *FEMS Microbiology Reviews*, vol. 21, Sep. 1997, 157-178.

Hamer et al., "Regulation In Vivo of a Cloned Mammalian Gene: Cadmium Induces the Transcription of a Mouse Metallothionein Gene in SV40 Vectors", *Journal of Molecular and Applied Genetics*, vol. 1, 1982, 273-288.

Hancock et al., "The role of antimicrobial peptides in animal defenses", *Proceedings of the National Academy of Sciences*, vol. 97, No. 16, Aug. 1, 2000, 8856-8861.

Hanks et al., "Protein kinases 6. The eukaryotic protein kinase superfamily: kinase (catalytic) domain structure and classification", *The FASEB Journal*, vol. 9, May 1995, 576-596.

Hardy et al., "Construction of Adenovirus Vectors though Cre-lox Recombination," *Journal of Virology*, vol. 71, No. 3, Mar. 1997, 1842-1849.

Hasan et al., "Control of cloned gene expression by promoter inversion in vivo: construction of improved vectors with multiple cloning site and the P.sub.tac promoter", *Gene*, vol. 56, 1987, 145-151.

Hasan et al., "*Escherichia coli* genome targeting, I. Cre-lox-mediated in vitro generation of ori plasmids and their in vivo chromosomal integration and retrieval", *Gene*, vol. 150, 1994, 51-56.

Hashimoto-Gotoh et al., "Improved vector, pHSG664, for direct streptomycin-resistance selection: cDNA cloning with G:C-tailing procedure and subcloning of double-digeste DNA fragments", *Gene*, vol. 41, 1986, 125-128.

Hehl et al., "Structural analysis of Tam3, a transposable element from *Antirrhinum majus*, reveals homologies to the Ac element from maize", *Plant Molecular Biology*, vol. 16, Kluwer Academic Publishers, 1991, 369-371.

Henikoff, "Unidirectional digestion with exonuclease III creates targeted breakpoints for DNA sequencing", *Gene*, vol. 28, 1984, 351-359.

Heyman et al., "Genome-scale cloning and expression of individual open reading frames using topoisomerase I-mediated ligation", *Genome Research*, vol. 9, No. 4, 1999, 383-392.

Hochuli et al., "Genetic Approach to Facilitate Purification of Recombinant Proteins with a Novel Metal Chelate Adsorbent", *BioTechnology*, vol. 6, Nov. 1988, 1321-1325.

Hoekstra et al., "Shuttle Mutagenesis: Bacterial Transposons for Genetic Manipulations in Yeast", *Methods in Enzymology*, vol. 194, 1991, 329-342.

Hoess et al., "The Cre-lox Recombination System", *Nucleic Acids and Molecular Biology*, vol. 4, Eckstein, F., et al., 1990, 99-109.

Hoess et al., "Formation of small circular DNA molecules via an in vitro site-specific recombination system", *Gene*, vol. 40, 1985, 325-329.

Hoess et al., "Interaction of the bacteriophage P1 recombinase Cre with the recombining site loxP", *Proceedings of the National Academy of Sciences (PNAS)*, vol. 81, Feb. 1984, 1026-1029.

Hoess et al., "Mechanism of Strand Cleavage and Exchange in the Cre-lox Site-specific Recombination System", *Journal of Molecular Biology*, vol. 181, 1985, 351-362.

Hoess et al., "P1 site-specific recombination: Nucleotide sequence of the recombining sites", *Proceedings of the National Academy of Sciences*, vol. 79, No. 11, Jun. 1, 1982, 3398-3402.

Hoess et al., "The role of the loxP spacer region in P1 site-specific recombination", *Nucleic Acids Research*, vol. 14, No. 5, 1986, 2287-2300.

Holt et al., "A novel phage Lamda replacement Cre-lox vector that has automatic subcloning capabilities", *Gene*, vol. 133, 1993, 95-97.

Hoogenboom et al., "Multi-subunit proteins on the surface of filamentous phage: methodologies for displaying antibody (Fab) heavy and light chains", *Nucleic Acids Research*, vol. 19, No. 15, 1991, 4133-4137.

Hopkins, "High titers of retrovirus (vesicular stomatitis virus) pseudotypes", *Proceedings of the National Academy of Sciences*, vol. 90, Oct. 1993, 8759-8760.

Huang et al., "A bacterial model system for chromosomal targeting", *Nucleic Acids Research*, vol. 19, No. 3, 1991, 443-448.

Huang et al., "Convenient and Reversible Site-Specific Targeting of Exogenous DNA into a Bacterial Chromosome by Use of the FLP Recombinase: the FLIRT System", *Journal of Bacteriology*, vol. 179, No. 19, Oct. 1997, 6076-6083.

Hwang et al., "Interaction of Integration Host Factor from *Escherichia coli* with the Integration Region of the *Haemophilus influenzae* Bacteriophage HPI", *Journal of Bacteriology*, vol. 172, No. 9, Sep. 1990, 4852-4860.

Iida et al., "A site-specific, conservative recombination system carried by bacteriophage P1. Mapping of the recombinase gene cin and the crossover sites cix for the inversion of the C Segment", *The EMBO Journal*, vol. 1, No. 11, 1982, 1445-1453.

Iino et al., "Trans-acting Genes of Bacteriophages P1 and Mu Mediate Inversion of a Specific DNA Segment Involved in Flagellar Phase Variation of *Salmonella*", *Cold Spring Harbor Symposia on Quantitative Biology*, vol. 45, 1981, 11-16.

Intitut Pasteur, Figure 1, http://www.pasteur.fr/recherche/unites/pmtg/integ/fig1.html, http://www.pasteur.fr/recherche/unites/pmtg/integ/fig1.html, Jun. 19, 2003, 1-2.

Institut Pasteur, Figure 2, http://www.pasteur.fr/recherche/unites/pmtg/integ/fig2.html, http://www.pasteur.fr/recherche/unites/pmtg/integ/fig2.html, Jun. 19, 2003, 1.

Institut Pasteur, Figure 3, http://www.pasteur.fr/recherche/unites/pmtg/integ/fig3.html, http://www.pasteur.fr/recherche/unites/pmtg/integ/fig3.html, Jun. 19, 2003, 1 page.

Institut Pasteur, Introduction, Institut Pasteur Website, http://www.pasteur.fr/recherche/unites/pmtg/integ/intro.html, Jun. 19, 2003, 1-9.

Institut Pasteur, Main Page, *Institut Pasteur Website Main page*, http://www.pasteur.fr/recherche/unites/pmtg, Jun. 19, 2003, 1.

Invitrogen, Directional TOPO Entry Vectors, http://www.invitrogen.com/content.cfm?pageid=3799&cfid=2897960&cftoken=88086554, Invitrogen Life Technologies, Directional TOPO Entry Vectors, Online Catalogue, Sep. 27, 2002, 1-4.

Invitrogen, The Echo Cloning System: The Future of Cloning is Here, Invitrogen Corporation available at: http://invitrogen.com/content/cfm?pageid=3371&cfid=16767784&cftoken=62396683, Cover page only taken from original site, as cited, Jul. 7, 2004, 1.

Invitrogen, The Echo Cloning System: The Future of Cloning is Here, *Invitrogen Online Catalogue*, http://web.archive.org/web/20010112191100/www.invitrogen.com/catalogue_project/cat_echo.html, Jul. 7, 2004, 1-8.

Jaffe et al., "Effects of the ccd Function of the F Plasmid on Bacterial Growth", *Journal of Bacteriology*, vol. 163, No. 3, Sep. 1985, 841-849.

Jayaram, "The Int Family of Site-specific Recombinases: Some thoughts on a General Reaction Mechanism", *Journal of Genetics*, vol. 67, No. 1, Apr. 1988, 29-36.

Jeong et al., "Cloning and nucleotide sequencing of the genes, rplU and rpmA, for ribosomal proteins L21 and L27 of *Escherichia coli*", *DNA sequencing and Mapping*, vol. 4, 1993, 59-67.

John et al., "Plasmids as Epidemiologic Markers in Nosocomial Gram-Negative Bacilli: Experience at a University and Review of the Literature", *Reviews of Infectious Diseases*, vol. 8, No. 5, Sep. 1986, 693-704.

Johnson et al., "Isolation of the gene encoding the Hin recombinational enhancer binding protein", *Proceedings of the National Academy of Sciences*, vol. 85, Genetics, May 1988, 3484-3488.

Johnston et al., "Isolation of the yeast regulatory gene GAL4 and analysis of its dosage effects on the galactose/melibiose regulon", *Proceedings of the National Academy of Sciences*, vol. 79, Nov. 1982, 6971-6975.

JP Application No. 2007-175995, Response to Aug. 27, 2009 Office Action filed on Feb. 10, 2009.

Kanaar et al., "Gin-Mediated Recombination of Catenated and Knotted DNA Substrates: Implications for the Mechanism of Interaction Between Cis-Acting Sites", *Cell*, vol. 58, Jul. 14, 1989, 147-159.

Kanegae et al., "Efficient gene activation in mammalian cells by using recombinant adenovirus expressing site-specific Cre recombinase", *Nucleic Acids Research*, vol. 23, No. 19, 1995, 3816-3821.

Kaniga et al., "A wide-host-range suicide vector for improving reverse genetics in Gram-negative bacteria: inactivation of the blaA gene of *Yersinia enterocolitica*", *Gene*, vol. 109, 1991, 137-141.

Katz et al., "Site-specific recombination in Esherichia coli between the att sites of plasmid pSE211 from *Saccharopolyspora erhthraea*", *Molecular and General Genetics*, vol. 227, 1991, 155-159.

Kealey et al., "Production of polyketide natural product in nonpolyketide-producing prokaryotic and eukaryotic hosts", *Proceedings of the National Academy of Sciences*, vol. 95, Jan. 1998, 505-509.

Kendall et al., "Plasmid Transfer in *Streptomyces lividans*: Identification of a kil-kor System Associated with the Transfer Region of plJ101", *Journal of Bacteriology*, vol. 169, No. 9, Sep. 1987, 4177-4183.

Kholodenko et al., "Metabolic Design: How to Engineer a Living Cell to Desired Metabolite Concentrations and Fluxes", *Biotechnology and Bioengineering*, vol. 59, No. 2, Jul. 20, 1998, 239-247.

Kijima, "Application of the Cre Recombinase/loxP System Further Enhances Antitumor Effects in Cell Type-specific Gene Therapy against Carcinoembryonic Antigen-producing Cancer", *Cancer Research*, vol. 59, Oct. 1, 1999, 4906-4911.

Kilby et al., "Site-specific recombinases: tools for genome engineering", *Trends in Genetics*, vol. 9, No. 12, Dec. 1993, 413-421.

Kim et al., "Use of the human elongation factor 1a promoter as a versatile and efficient expression system", *Gene*, Vol. 91, 1990, 217-223.

Kim et al., "Lambda Int Protein Bridges Between Higher Order Complexes at Two Distant Chromosomal Loci attL and attR",*Science*, vol. 256, Apr. 10, 1992, 198-203.

Kitts et al., "Bacteriophage Lambda Site-specific Recombination Proceeds with a Defined Order of Strand Exchanges", *J. Mol. Biol.*, vol. 204, 1988, 95-107.

Klippel et al., "Isolation and characterization of unusual gin mutants", *The EMBO Journal*, vol. 7, No. 12, 1988, 3983-3989.

Koch et al., "*Escherichia coli* host factor for site-specific DNA inversion: Cloning and characterization of the fis gene", *Proceedings of the National Academy of Sciences*, vol. 85, Jun. 1988, 4237-4241.

Kolb et al., "Genome targeting with an MBP-Cre fusion protein", *Gene*, vol. 183, Dec. 1996, 53-60.

Kouprina et al., "Rescue of Targeted Regions of Mammalian Chromosomes by in Vivo Recombination in Yeast", *Genome Research*, vol. 8, 1998, 666-672.

Kozak, "An analysis of 5'-noncoding sequences from 699 vertebrate messenger RNAs", *Nucleic Acids Research*, vol. 15, No. 20, 1987, 8125-8132.

Kozak, "Comparison of initiation of protein synthesis in procaryotes, Eucaryotes, and organelles", *Microbiological Reviews*, vol. 47, No. 1, Mar. 1983, 1-45.

Kozak, "Structural features in eukaryotic mRNAs that modulate the initiation of translation", *The Journal of Biological Chemistry*, vol. 266, No. 30, Oct. 25, 1991, 19867-19870.

Krafte et al., "Stable Expression and Functional Characterization of a Human Cardiac Na.sup.+ Channel Gene in Mammalian Cells", Journal of Molecular and Cellular Cardiology, vol. 27, 1995, 823-830.

Krautwald et al., "Bacterially expressed murine CSF-1 possesses agonistic activity in its monomeric form", *Biochemican Biophysical Research Communications*, vol. 192, No. 2, Apr. 30, 1993, 720-727.

Kuempel et al., "Use of a transposon (Tndif) to obtain suppressing and nonsuppressing insertions of the dif resolvase site of *Eschericia coli*", *Genes & Development*, vol. 10, May 1, 1996, 1162-1171.

Kuhn et al., "Inducible Gene Targeting in Mice", *Science*, vol. 269, Sep. 8, 1995, 1427-1429.

Lafontaine et al., "One-step PCR Mediated Strategy for the construction of Conditionally Expressed and Epitope Tagged Yeast Protein", *Nucleic Acids Research*, vol. 24, No. 17, Sep. 1, 1996, 3469-3471.

Lake, "Evolving Ribosome Structure: Domains in Archaebacteria, Eubacteria, Eocytes and Eukaryotes", *Annual Review of Biochemistry*, vol. 54, 1985, 507-530.

Lakso et al., "Targeted Oncogene activation by site-specific recombination in transgenic mice", *Proceedings of the National Academy of Sciences*, vol. 89, Jul. 1992, 6232-6236.

Lander, "The New Genomics: Global View of Biology", *Science*, vol. 274, Oct. 25, 1996, 536-539.

Landy, "Dynamic, structural and regulatory aspects of lambda site-specific recombination.", *Annu. Rev. Biochem.*, vol. 58, Annual Reviews Inc, 1989, 913-949.

Landy, "Mechanistic and structural complexity in the site-specific recombination pathways of Int and FLP.", *Current Opinion in Genetics and Development*, vol. 3, 1993, 699-707.

Langeveld et al., "Expression of an *Escherichia coli* phr gene in the yeast *Saccharomyces cerevisiae*", *Molecular and General Genetics*, vol. 199, 1985, 396-400.

Lebreton et al., "Mutations That Improve the Binding of Yeast FLP Recombinase to Its Substrate", *Genetics*, vol. 118, Mar. 1988, 393-400.

Lee et al., "Genetic Analysis of *Escherichia coli* Integration Host Factor Interactions with Its Bacteriophage lamba H' Recognition Site", *The Journal of Bacteriology*, vol. 173, No. 2, Jan. 1991, 609-617.

Lee et al., "Role of Nucleotide Sequences of loxP Spacer Region in Cre-mediated Recombination", *Gene*, vol. 216, Aug. 1998, 55-65.

Lee et al., "Site-spectific integration of mycobacteriophage L5: Integration-proficient vectors for *Mycobacterium smegmatis, Mycobacterium tubercoulosis*, and bacille Calmette-Guerin", *Proceedings of the National Academy of Sciences*, vol. 88, Apr. 1991, 3111-3115.

Lenski et al., "Genetic Analysis of a Plasmid-Encoded, Host Genotype-Specific Enhancement of Bacterial Fitness", *Journal of Bacteriology*, vol. 176, No. 11, Jun. 1994, 3140-3147.

Leong et al., "Generation of single base-pair deletions, insertions, and substitutions by a site-specific recombination system", *Proceedings of the National Academy of Sciences*, vol. 82, Oct. 1985, 6990-6994.

Leslie et al., "Site-specific Recombination in the Replication Terminus Region of *Escherichia coli*: Functional Replacement of dif", *The EMBO Journal*, vol. 14, No. 7, 1995, 1561-1570.

Leung, "Application of Combinatorial Libraries and Protein Engineering to the Discovery of Novel Anti-Thrombotic Drugs", *Thrombosis and Haemostasis*, vol. 74, No. 1, 1995, 373-376.

Li et al., "Generation of mice with a 200-kb amyloid precursor protein gene deletion by Cre recombinase-medicated site-specific recombination in embryonic stem cells", *Proceedings of the National Academy of Sciences*, vol. 93, Jun. 1996, 6158-6162.

Lieber et al., "Recombinant Adenoviruses with Large Deletions Generated by Cre-Mediated Excision Exhibit Different Biological Properties Compared with First-Generation Vectors In Vitro and In Vivo", *Journal of Virology*, vol. 70, No. 12, Dec. 1996, 8944-8960.

Liu et al., "The univector plasmid-fusion system, a method for rapid construction of recombinant DNA without restriction enzymes", *Current Biology*, vol. 8, No. 24, 1998, 1300-1309.

Liu et al., "Mapping the 5' and 3' Ends of *Tetrahymena thermophelia* mRNAs USing RNA Ligase Mediated Amplification of cDNA Ends (RLM-RACE)", *Nucleic Acids Research*, vol. 21, No. 21, 1993, 4954-4960.

Lorbach et al., "Site-specific Recombination in Human cells Catalyzed by Phage Lamda Integrase Mutants", *Journal of Molecular Biology*, vol. 296, Mar. 2000, 1175-1181.

Lu et al., "Conjugative transposition: Tn916 integrase contains two independent DNA binding domains that recognize different DNA sequences", *The EMBO Journal*, vol. 13, No. 7, 1994, 1541-1548.

Luckow et al., "Efficient Generation of Infectious recombinant Baculoviruses by Site-Specific Transposon-Mediated Insertion of Foreign Genes into a Baculovirus Genome Propagated in *Escherichia coli*", *Journal of Virology*, vol. 67, No. 8, Aug. 1993, 4566-4579.

Lyznik et al., "Activity of yeast FLP recombinase in maize and rice protoplast", *Nucleic Acids Research*, vol. 21, No. 4, 1993, 969-975.

Machattie et al., "Chromosomal integration of phage [lambda] by means of a DNA insertion element", *Proceedings of the National Academy of Sciences*, vol. 75, No. 3, Mar. 1978, 1490-1494.

Mackie et al., "Nucleotide Sequence of the Gene for Ribosomal Protein S20 and Its Flanking Regions", *The Journal of Biological Chemistry*, vol. 256, No. 15, Aug. 10, 1981, 8177-8182.

Madison et al., "Metabolic Engineering of Poly(3-Hydroxyalkanoates): From DNA to Plastic", *Microbiology and Molecular Biology Reviews*, vol. 63, No. 1, Mar. 1999, 21-53.

Maemura et al., "Generation of a Dominant-negative Mutant of Endothelial PAS Domain Protein 1 by Deletion of a Potent C-terminal Transactivation Domain", *The Journal of Biological Chemistry*, vol. 274, No. 44, Oct. 29, 1999, 31565-31570.

Maeser et al., "The Gin Recombinase of Phage Mu Can Catalyse Site-Specific Recombination in Plant Protoplasts.", *Molecular and General Genetics*, vol. 230, 1991, 170-176.

Mahillon et al., "IS231 and other *Bacillus thuringiensis* elements: a review.", *Genetica*, vol. 93, 1994, 13-26.

Mahillon et al., "Subdivision of the *Escherichia coli* K-12 genome for sequencing: manipulation and DNA sequence of transposable elements introducing unique restriction sites", *Gene*, vol. 223, 1998, 47-54.

Malynn et al., "The Scid Defect Affects the Final Step of the Immunoglobulin VDJ Recombinase Mechanism", *Cell*, vol. 54, Aug. 12, 1988, 453-460.

Maniatis, "Ch 11: Recombinant DNA Procedures in the study of Eukaryotic Genes", *Cell Biology: A Comprehensive Treatise*, vol. 3, Gene Expression: The Production of RNA's, Goldstein, L., and Prescott, D.M., eds., 1980, 563-608.

Maniatis et al., "Regulation of Inducible and Tissue-Specific Gene Expression", *Science*, vol. 236, Jun. 5, 1987, 1237-1245.

Manning et al., "Gene capture in *Vibrio cholerae*", *Trends in Microbiology*, vol. 7, No. 3, Mar. 1999, 93-95.

Matsuzaki et al., "Chromsome Engineering in *Saccharomyces cerevisiae* by Using a Site-Specific Recombination System of a Yeast Plasmid", *The Journal of Bacteriology*, vol. 172, No. 2, Feb. 1990, 610-618.

Mayer et al., "Signalling through SH2 and SH3 domains", *Trends Cell Biology*, vol. 3, Jan. 3, 1993, 8-13.

McCarthy et al., "Prokaryotic translation: the interactive pathway leading to initiation", *Trends Genet.* vol. 10, No. 11, Elsevier Trends Journals, Nov. 1994, 402-407.

McKnight, "Functional Relationships between Transcriptional Control Signals of the Thymidine Kinase Gene of Herpes Simplex Virus", *Cell*, vol. 31, Dec. 1982, 355-365.

Medberry et al., "Intra-chromosomal rearrangements generated by Cre-lox site-specific recombination", *Nucleic Acids Research*, vol. 23, No. 3, 1995, 485-490.

Mendiola et al., "Specificity of Insertion of IS91, an Insertion Sequence Present in .alpha.-haemolysis Plasmids of *Escherichia coli*", *Molecular Microbiology*, vol. 3, No. 7, 1989, 979-984.

Mercier et al., "Structural and Functional Characterization of tnpI, a Recombinase Locus in Tn21 and Related .beta.-Lactamase Transposons", *Journal of Bacteriology*, vol. 172, No. 7, Jul. 1990, 3745-3757.

Metcalf et al., "Conditionally Replicative and Conjugative Plasmids Carrying lacZ.alpha for Cloning, Mutagenesis, and Allele Replacement in Bacteria", *Plasmid*, vol. 35, No. 0001, 1996, 1-13.

Mette et al., "Transcriptional silencing and promoter methylation triggered by double-stranded RNA", *The EMBO Journal*, vol. 19, No. 19, 2000, 5194-5201.

Meyer-Leon et al., "Purification of the FLP Site-Specific Recombinase by Affinity Chromatography and Re-Examination of Basic Properties of the System", *Nucleic Acids Research*, vol. 15, No. 16, 1987, 6469-6488.

Miki et al., "Control of Segregation of Chromosomal DNA by Sex Factor P in *Escherichia Coli*. Mutants of DNA Gyrase Subunit A Suppress letD (ccdB) Product Growth Inhibition", *Journal of Molecular Biology*, vol. 225, 1992, 39-52.

Miller et al., "Direct Role of the himA Gene Product in Phage lambda Integration", *Nature*, vol. 290, Apr. 9, 1981, 523-526.

Miller et al., "int-h: an int Mutation of Phage λ That Enhances Site Specific Recombination", *Cell*, vol. 20, Jul. 1980, 721-729.

Mizushima et al., "pEF-BOS, a Powerful Mammalian Expression Vector", *Nucleic Acids Research*, vol. 18, No. 17, 1990, 5322.

Mizuuchi et al., "Integrative Recombination of Bacteriophage Lamda: In Vitro Study of the Intermolecular Reaction", *Cold Spring Harbor Symposia on Quantitative Biology*, vol. 43, Cold Spring Harbor Laboratory Press, 1979, 1111-1114.

Mizuuchi, Michiyo et al., "Integrative recombination of bacteriophage lambda: Extent of the DNA sequence involved in attachment site function", vol. 77, No. 6, *Proceedings of the National Academy of Sciences (PNAS)*, Jun. 1980, 3220-3224.

Mizuuchi et al., "The extent of DNA sequence required for a functional bacterial attachment site of phage lambda", *Nucleic Acids Research*, vol. 13, No. 4, 1985, 1193-1208.

Mozo et al., "Design of a novel system for the construction of vectors for *Agrobacterium*-mediated plant transformation", *Molecular and General Genetics*, vol. 236, No. 1, 1992, 1-7.

Mullins et al., "Efficient Cre-lox linearisation of BACs: applications to physical mapping and generation of transgenic animals", *Nucleic Acids Research*, vol. 25, No. 12, 1997, 2539-2540.

Murayama et al., "Evidence for Involvement of *Escherichia coli* Genes pmbA, csrA and a Previously unrecognized Gene tldD, in the Control of Gyrase by letD (ccdB) of Sex Factor F", *Journal of Molecular Biology*, vol. 256, 1996, 483-502.

Muskhelishvili et al., "SSVI-encoded site-specific recombination system in Suliolobus shibatse", *Molecular and General Genetics*, vol. 237, No. 3, 1993, 334-34.

Nagaraja et al., "Specificity Determinants in the Attachment Sites of Bacteriophages HK022 and .lamda", *The Journal of Bacteriology*, vol. 172, No. 11, Nov. 1990, 6540-6550.

Nagy, "Cre Recombinase: The Universal Reagent for Genome Tailoring", *Genesis*, vol. 26, 2000, 99-109.

Nash, "Bending and supercoiling of DNA at the attachment site of bacteriophage lambda", *Trends in Biochemical Science*, vol. 15, Jun. 1990, 222-227.

Nash et al., "Heteroduplex substrates for bacteriophage lambda site-specific recombinantion: cleavage and strand transfer products", *The EMBO Journal*, vol. 8, No. 11, 1989, 3523-3533.

Nash, "Integrative Recombination of Bacteriophage Lambda DNA In Vitro", *Proceedings of the National Academy of Sciences*, vol. 72, No. 3, Mar. 1975, 1072-1076.

Nash et al., "Purification and Properties of the Bacteriophage Lambda Int Protein", *Methods in Enzymology*, vol. 100, 1983, 210-216.

Nash et al., "Purification and properties of the *Escherichia coli* protein factor required for lambda integrative recombination", *The Journal of Biological Chemistry*, vol. 256, No. 17, Sep. 10, 1981, 9246-9253.

Nash et al., "Role of homology in site-specific recombination of bacteriophage .lamda.: Evidence against joining of cohesive ends", *Proceedings of the National Academy of Sciences*, vol. 84, Jun. 1987, 4049-4053.

Ng et al., "A High-Efficiency Cre/loxP-Based System for Construction of Adenoviral Vectors", Human Gene Therapy, vol. 10, Nov. 1, 1999, 2667-2672.

Nomura et al., "Regulation of the Synthesis of Ribosomes and Ribosomal Components", Annual Review of Biochemistry, vol. 53, 1984, 75-117.

Numrych et al., "A comparison of the effects of single-base and triple-base changes in the integrase arm-type binding sites on the site-specific recombination of bacteriophage lambda", *Nucleic Acids Research*, vol. 18, No. 13, 1990, 3953-3959.

Numrych et al., "Characterization of the bacteriophage lambda exisionase (Xis) protein: the C-terminus is required for Xis-integrase cooperativity but not for DNA binding ", *The EMBO Journal*, vol. 11, No. 10, 1992, 3797-3806.

Nunes-Duby et al., "Half-att Site Substrates Reveal the Homology Independence and Minimal Protein Requrements for Productive Synapsis in .lamda. Excisive Recombination", *Cell*, vol. 59, Oct. 6, 1989, 197-206.

Nunes-Duby et al., "Lambda Integrase cleaves DNA in cis", *The EMBO Journal*, vol. 13, 1994, 4421-4430.

Nunes-Duby et al., "Similarities and differences among 105 members of the Int family of site-specific recombinases", *Nucleic Acids Research*, vol. 26, No. 2, 1998, 391-406.

Oberto et al., "A segment of the phage HK022 chromosome is a mosaic of other lambdoid chromosomes", *Nucleic Acids Research*, vol. 22, No. 3, 1994, 354-356.

Odell et al., "Seed-Specific Gene Activation Mediated by the Cre/lox Site Specific Recombination System", *Plant Physiology*, vol. 106, 1994, 447-458.

O'Gara et al., "Identification and Molecular Genetic Analysis of Multiple Loci Contributing to High-Level Tellurite Resistance in *Rhodobacter sphaeroides* 2.4.1", *Applied and Environmental Microbiology*, vol. 63, No. 12, Dec. 1997, 4713-4720.

O'Hara et al., "Directional cDNA library construction assisted by the in vitro recombination reaction", *Nucleic Acids Research*, vol. 29, No. 4, Feb. 15, 2001, 1-8.

Okayama et al., "Bacteriophage Lambda Vector for Transducing a cDNA Clone Library into Mammalian Cells", Molecular and Cellular Biology, vol. 5, May 1985, 1136-1142.

Oliner et al., "In vivo cloning of PCR products in *E. coli*", *Nucleic Acids Research*, vol. 21, No. 22, 1993, 5192-5197.

Orban et al., "Tissue- and site-specific DNA recombination in transgenic mice", *Proceedings of the National Academy of Sciences*, vol. 89, Aug. 1992, 6861-6865.

Osborne et al., "A system for insertional mutagenesis and chromosomal rearrangement using the Ds transposon and Cre-lox", *The Plant Journal*, vol. 7, No. 4, 1995, 687-701.

Osuna et al., "Identification of two functional regions in Fis: the N-terminus is required to promote Hin-mediated DNA inversion but not Lambda excision", *The EMBO Journal*, vol. 10, No. 6, 1991, 1593-1603.

Padgett et al., "Creating seamless junctions independent of restricition sites in PCR cloning", *Gene*, vol. 168, 1996, 31-35.

Pal et al., "P1 Plasmid Replication. Role of Initiator Titration in Copy Number Control", *Journal of Molecular Biology*, vol. 192, 1986, 275-285.

Palazzolo et al., "Phage lambda cDNA cloning vectors for subtractive hybridization, fusion-protein synthesis and Cre-loxP automatic plasmid subcloning", *Gene*, vol. 88, Issue 1, Mar. 30, 1990, 25-36.

Pan et al., "Ligation of Synthetic Activation DNA Substrates by Site-specific Recombinases and Topoisomerase I", *The Journal of Biological Chemistry*, vol. 268, No. 5, Feb. 15, 1993, 3683-3689.

Parks et al., "A Helper-Dependent System for Adenovirus Vector Production Helps Define a Lower Limit for Efficient DNA Packaging", *Journal of Virology*, vol. 71, No. 4, Apr. 1997, 3293-3298.

Patel et al., "DNA polymerase active site is highly mutable: Evolutionary consequences", *Proceedings of the National Academy of Sciences*, vol. 97, No. 10, May 9, 2000, 5095-5100.

PCT/US00/05432, International Search Report mailed May 23, 2000.

PCT/US97/21880, International Search Report mailed Sep. 1, 1998.

PCT/US98/22589, International Search Report mailed Feb. 5, 1999.

Peakman et al., "Highly efficient generation of recombinant baculovirus by enzymatically mediated site-specific in vitro recombination", *Nucleic Acids Research*, vol. 20, No. 3, 1992, 495-500.

Peredelchuk et al., "A method for construction of *E. coli* strains with multiple DNA insertions in the Chromosome", *Gene*, vol. 187, 1997, 231-238.

Perler, "InBase, the New England Biolabs Intein Database", *Nucleic Acids Research*, vol. 27, No. 1, 1999, 346-347.

Persson, "Combinatorial Libraries", *Intern. Rev. Immunol.*, vol. 10, 1993, 153-163.

Petersen et al., "Histidine 265 is Important for Covalent Catalysis by Vaccinia Topoisormerase and is Conserved in all Eukaryotic Type I Enzymes", *Journal of Biological Chemistry*, vol. 272, No. 7, Feb. 14, 1997, 3891-3896.

Phillips-Jones et al., "Context effects on misreading and suppression of UAG codons in human cells.", *Molecular and Cellular Biology*, vol. 15, No. 12, Dec. 1995, 6593-6600.

Pichel et al., "Timing of SV40 oncongene activation by site-specific recombination determines subsequent tumor progression during murine lens development", *Oncogene*, vol. 8, 1993, 3333-3342.

Pierce et al., "A positive selection vector for cloning high molecular weight DNA by the bacteriophage P1 system: Improved cloning efficacy", *Proceedings of the National Academy of Sciences*, vol. 89, Mar. 1992, 2056-2060.

Ping et al., "Dynamics of RNA-protein interactions in the HIV-1 Rev-RRE complex visualized by 6-thyoguanosine-mediated photocrosslinking", *RNA*, vol. 3, 1997, 850-860.

Podhajska et al., "Control of cloned gene expression by promoter inversion in vivo: construction of the heat-pulse-activated att-nutL-p-att-N module", *Gene*, vol. 40, 1985, 163-168.

Posfai et al., "In vivo excision and amplification of large segments of the *Escherichia coli* genome", *Nucleic Acids Research*, vol. 22, No. 12, 1994, 2392-2398.

Powell, "Enhanced concatemer cloning—a modification to the SAGE (Serial Analysis of Gene Expression) Technique", *Nucleic Acids Research*, vol. 26, No. 14, 1998, 3445-3446.

Prasad et al., "Substrate Recognition by the 2um Circle Site-Specific Recombinase: Effect of Mutations within the Symmetry Elements of the Minimal Substrate", vol. 6, No. 12, *Molecular and Cellular Biology*, Dec. 1986, 4329-4334.

Prieto et al., "Molecular Characterization of the 4-Hydroxyphenylacetate Catabolic Pathway of *Escherichia coli* W: Engineering a Mobile Aromatic Degradative Cluster", *Journal of Bacteriology*, vol. 178, No. 1, Jan. 1996, 111-120.

Qian et al., "Reactions between Half-and Full-FLP Recombination Target Sites: A Model System for Analyzing Early Steps in FLP Protein-Mediated Site-Specific Recombination", *The Journal of Biological Chemistry*, vol. 267, No. 1, Apr. 15, 1992, 7794-7805.

Qin et al., "Cre recombinase-mediated site-specific recombination between plant chromosomes", *Proceedings of the National Academy of Sciences*, vol. 91, Mar. 1994, 1706-1710.

Qin et al., "Site-specific cleavage of chromosomes in vitro through Cre-lox recombination", *Nucleic Acids Research*, vol. 23, No. 11, 1995, 1923-1927.

Rausch et al., "Structural Analysis of the actinophage phi C31 attachment site", *Nucleic Acids Research*, vol. 19, No. 19, 1991, 5187-5189.

Reed et al., "Transposon-Mediated Site-Specific Recombination in vitro: DNA Cleavage and Protein-DNA Linkage at the Recombination Site", *Cell*, vol. 25, No. 3, Sep. 1981, 721-728.

Reed, "Transposon-Mediated Site-Specific Recombination: A Defined in Vitro System", *Cell*, vol. 25, Sep. 1981, 713-719.

Richet et al., "Synapsis of Attachment Sites during Lambda Integrative Recombination Involves Capture of a Naked DNA by a Protein-DNA Complex", *Cell*, vol. 52, Jan. 15, 1988, 9-17.

Richet et al., "The Interaction of Recombination Proteins with Supercoiled DNA: Defining the Role of Supercoiling in Lambda Integrative Recombination", *Cell*, vol. 46, Sep. 26, 1986, 1011-1021.

Ross et al., "Patterns of Lamda Int Recognition in the Regions of Strand Exchange", *Cell*, vol. 33, May 1983, 261-272.

Russell, "A recombination-based cloning system that decreases time to protein analysis", *American Biotechnology Laboratory*, vol. 18, No. 7, Jun. 2000, 8-10.

Sadowski et al., "A Noncatalytic Domain Conserved among Cytoplasmic Protein—Tyrosine Kinases Modifies the Kinase Function and Transforming Activity of Fujinami Sarcoma Virus P130.sup.gag-fps", *Molecular and Cellular Biology*, vol. 6, No. 12, Dec. 1986, 4396-4408.

Sadowski, "Site-Specific Recombinases: Changing Partners and Doing the Twist", *Journal of Bacteriology*, vol. 165, No. 2, Feb. 1986, 341-347.

Sadowski, "Site-Specific Genetic Recombination: Hops, Flips and Flops", *Faseb Journal*, vol. 7, No. 9, Jun. 1993, 760-767.

Sadowski, "The Flp recombinase of the 2-microns plasmid of *Saccharomyces cerevisiae*", *Progress in Nucleic Acid Research and Molecular Biology*, vol. 51, 1995, 53-91.

Sambrook et al., "Ch: 16.6-16.8—Termination and Polyadenylation Signals", *Molecular Cloning: A Laboratory Manual*, Second Edition, Cold Spring Harbor Laboratory Press, 1989, 16.6-16.8.

Sandhu, "Protein Engineering of Antibodies", *Critical Reviews in Biotechnology*, vol. 12, No. 5/6, 1992, 437-462.

Sato et al., "The cisA Cistron of *Bacillus subtilis* Sporulation Gene spoIVC Encodes a Protein Homologous to a Site-Specific Recombinase", *Journal of Bacteriology*, vol. 172, No. 2, Feb. 1990, 1092-1098.

Sauer et al., "Construction of Isogenic Cell Lines Expressing Human and Rat Angiotensin II AT1 Receptors by Cre-Mediated Site-Specific Recombination", *Methods: A Companion to Methods in Enzymology*, vol. 4, 1992, 143-149.

Sauer et al., "Cre-stimulated recombination at loxP-containing DNA sequences placed into the mammalian genome", *Nucleic Acids Research*, vol. 17, No. 1, 1989, 147-161.

Sauer et al., "Expression and Functioning in Yeast of a Bacterial Site Specific Recombination System", *Journal of Cellular Biochemistry*, Supplement 10B, Abstract # I340, 1986, 242.

Sauer, "Functional Expression of the cre-lox Site-Specific Recombination System in the Yeast *Saccharomyces cerevisiae*", *Molecular and Cellular Biology*, vol. 7, No. 6, Jun. 1987, 2087-2096.

Sauer, "Inducible gene targeting in mice using the Cre/lox system", *Methods: A Companion to Methods in Enzymology*, vol. 14, Apr. 1998, 381-392.

Sauer, "Manipulation of Transgenes by Site-Specific Recombination: Use of Cre Recombinase", *Methods in Enzymology*, vol. 225, 1993, 890-900.

Sauer, "Multiplex Cre/lox recombination permits selective site-specific DNA targeting to both a natural and an engineered site in the yeast genome", *Nucleic Acids Research*, vol. 24, No. 23, 1996, 4608-4613.

Sauer et al., "Site-specific DNA Recombination in mammalian cells by the Cre recombinase of bacteriophage P1", *Proceedings of the National Academy of Sciences*, vol. 85, Jul. 1988, 5166-5170.

Sauer et al., "Site-specific insertion of DNA into a pseudorabies virus vector", *Proceedings of the National Academy of Sciences*, vol. 84, Dec. 1987, 9108-9112.

Sauer, "Site-specific recombination: developments and applications.", *Current Opinion in Biotechnology*, vol. 5, 1994, 521-527.

Sauer et al., "Targeted Insertion of Exogenous DNA into the Eukaryotic Genome by the Cre Recombinase", *The New Biologist*, vol. 2, No. 5, May 1990, 441-449.

Sauer et al., "The Cyclization of linear DNA in *Escherichia coli* by site-specific recombination", *Gene*, vol. 70, 1988, 331-341.

Schild et al., "Cloning of Three Human Multifunctions de novo Purine Biosynthetic Genes by Functional Complementation of Yeast Mutations", *Proceedings of the National Academy of Sciences*, vol. 87, Apr. 1990, 2916-2920.

Schindelhauer et al., "Efficient combination of large DNA in vitro: in gel site specific recombination (IGSSR) of PAC fragments containing a satellite DNA and the human HPRT gene locus", *Nucleic Acids Research*, vol. 25, No. 11, 1997, 2241-2243.

Schlake et al., "Use of Mutated Recognition Target (FRT) Sites for the Exchange of Expression Cassettes at Defined Chromosomal Loci", *Biochemestry*, vol. 33, No. 43, Nov. 1994, 12746-12751.

Schnepf et al., "*Bacillus thuringiensis* and Its Pesticidal Crystal Proteins", *Microbiology and Molecular Biology Reviews*, vol. 62, No. 3, Sep. 1998, 775-806.

Segall et al., "Architectural Elements in Nucleoprotein Complexes: Interchangeability of Specific and Non-specific DNA Binding Proteins", *The EMBO Journal*, vol. 13, No. 19, 1994, 4536-4548.

Segall et al., "Architectural flexibility in lambda site-specific recombination: three Alternate conformations channel the attL site into three distinct pathways", *Genes to Cells*, vol. 1, May 1996, 453-463.

Segall et al., "Synaptic intermediates in bacteriophage lambda site specific recombination: integrase can align pairs of attachment sites", *The EMBO Journal*, vol. 12, No. 12, 1993, 4567-4576.

Senecoff et al., "DNA Recognition by the FLP Recombinase of the Yeast 2 micro Plasmid—A Mutational Analysis of the FLP Binding Site", *Journal of Molecular Biology*, vol. 201, 1988, 405-421.

Senecoff et al., "The FLP recombinase of the yeast 2-μm plasmid: Characterization of its recombination site", *Proceedings of the National Academy of Sciences*, vol. 82, Nov. 1985, 7270-7274.

Shaikh et al., "The Cre Recombinase Cleaves the lox Site in trans", *The Journal of Biological Chemistry*, vol. 272, Feb. 1997, 5695-5702.

Sheffield et al., "Overcoming expression and purification problems of RhoGDI using a Family of "Parallel" expression vectors", *Protein Expression and Purification*, vol. 15, 1999, 34-39.

Shim et al., "Distinct and Redundant Functions of mu1 Medium Chains of the AP-1 Clathrin-Associated Protein Complex in the Nematode *Caenorhabditis elegans*", *Molecular Biology of the Cell*, vol. 11, Aug. 2000, 2743-2756.

Shirai et al., "Site-Specific Integration of the Actinophage R4 Genome into the Chromosome of *Streptomyces parvulus* upon Lysogenization", *Journal of Bacteriology*, vol. 173, No. 13, Jul. 1991, 4237-4239.

Short et al., "λZAP: A bacteriophage λ expression vector with in vivo excision properties", *Nucleic Acids Research*, vol. 16, No. 15, Aug. 11, 1988, 7583-7600.

Shuman et al., "Characterization of Vaccinia Virus DNA Topoisomerase I Expressed in *Escherichia coli*", *Journal of Biological Chemistry*, vol. 263, Nov. 5, 1988, 16401-16407.

Shuman, "Novel approach to molecular cloning and polynucleotide synthesis using vaccinia DNA Topoisomerase", *The Journal of Biological Chemistry*, vol. 269, No. 51, Dec. 23, 1994, 32678-32684.

Shuman, "Recombination mediated by vaccinia virus DNA topoisomerase I in *Escherichia coli* is sequence specific", *Proceedings of the National Academy of Sciences*, vol. 88, No. 22, Nov. 1991, 10104-10108.

Shuman, "Site-specific Interaction of Vaccinia Virus Topoisomerase I with Duplex DNA. Minimal DNA Substrate for Strand Cleavage In Vitro", *The Journal of Biological Chemistry*, Erratum, vol. 266, No. 17, Jun. 15, 1991, 11372-11379.

Shuman, "Site-specific interaction of Vaccinia Virus Topoismerase I with Duplex DNA.Minimal DNA Substrate for Strand Cleavage In Vitro", *Journal of Biological Chemistry*, vol. 266, No. 17, Jun. 15, 1991, 11372-11379.

Silver et al., "Amino terminus of the yeast GAL4 gene product is sufficient for nuclear localization", *Proceedings of the National Academy of Sciences*, vol. 81, Oct. 1984, 5951-5955.

Simpson et al., "Systematic Subcellular Localization of Novel Proteins Identified by Large-scale cDNA Sequencing", *EMBO Reports*, vol. 1, No. 3, 2000, 287-292.

Sinclair, "Honing Your Cloning. New cloning systems give protein expression studies a boost", *The Scientist*, Vol, 14, No, 16, Aug. 21, 2000, 28-32.

Sizemore et al., "Quantitative analysis of Tn10 Tet respressor binding to a complete set of tet operator mutants", *Nucleic Acids Research*, vol. 18, No. 10, 1990, 2875-2880.

Skraly et al., "Construction and Characterization of a 1,3-Propanediol Operon", *Applied and Environmental Microbiology*, vol. 64, No. 1, Jan. 1998, 98-105.

Smith et al., "A site-directed chromosmal translocation induced in embryonic stem cells by Cre-loxP recombination", *Nature Genetics*, vol. 9, Apr. 1995, 376-385.

Snaith et al., "Multiple cloning sites carrying loxP and FRT recognition sites for the Cre and Flp site-specific recombinases", *Gene*, vol. 166, Dec. 1995, 173-174.

Spengler et al., "The stereostructure of knots and catenanes produced by the phage lambda integrative recombination: implications for mechanism and DNA structure", *Cell*, vol. 42, Aug. 1985, 325-334.

Spinella et al., "Tandem arrayed ligation of expressed sequence tags (TALEST): a new method for generating global gene expression profiles", *Nucleic Acids Research*, vol. 27, No. 18, 1999, i-viii.

Stark et al., "Catalysis by site-specific recombinases", *Trends in Genetics*, vol. 8, No. 12, Dec. 1992, 432-439.

Stark et al., "Site-specific Recombination by TN3 Resolvase: Topological Changes in the Forward and Reverse Reactions", *Cell*, vol. 58, Aug. 25, 1989, 779-790.

Stassi et al., "Ethyl-substituted erythromycin derivatives produced by directed metabolic engineering", *Proceedings of the National Academy of Sciences*, vol. 95, Jun. 1998, 7305-7309.

Sternberg et al., "Site-specific Recombination and Its Role in the Life Cycle of Bacteriophage P1", *Cold Spring Harbor Symp. Quant. Biol.*, vol. 45, Cold Spring Harbor Laboratory Press, 1981, 297-309.

Sternberg, "Bacteriophage P1 cloning system for the isolation, amplification, and recovery of DNA fragments as large as 100 kilobase pairs", *Proceedings of the National Academy of Sciences*, vol. 87, Jan. 1990, 103-107.

Sternberg et al., "Bacteriophage P1 cre Gene and its Regulatory Region. Evidence for Multiple Promoters and for Regulation by DNA Methylation", *Journal of Molecular Biology*, vol. 187, 1986, 197-212.

Storck et al., "Rapid construction in yeast of complex targeting vectors for gene manipulation in the mouse", *Nucleic Acids Research*, vol. 24, No. 22, 1996, 4594-4596.

Strathmann et al., "Transposon-facilitated DNA sequencing", *Proceedings of the National Academy of Sciences*, vol. 88, Feb. 1991, 1247-1250.

Stryer, "The DNA Template Contains Stop Signals for transcription", *Biochemistry, Second Edition*, W.H. Freeman and Co., San Francisco, 1981, 610.

Stuurman et al., "Single-site manipulation of tomato chromosomes in vitro and in vivo using Cre-lox site-specific recombination", *Plant Molecular Biology*, vol. 32, No. 5, Dec. 1, 1996, 901-913.

Sugiura et al., "Minimal Essential Origin of Plasmid pSC101 Replication: Requirement of a Region Downstream of Iterons", *Journal of Bacteriology*, vol. 175, No. 18, Sep. 1993, 5993-6001.

Temple et al., "Construction of a functional human suppressor tRNA gene: an approach to gene therapy for beta-thalassaemia.", *Nature*, vol. 296, Apr. 8, 1982, 537-540.

Thompson et al., "Helical-repeat dependence of integrative recombination of bacteriophage lambda: Role P1 and H1 protein binding sites", *Proceedings of the National Academy of Sciences*, vol. 85, Sep. 1988, 6323-6327.

Thompson et al., "Mutations in an Integration Host Factor-Binding Site: Effect on Lambda Site-Specific Recombination and Regulatory Implications", *Journal of Bacteriology*, vol. 168, No. 3, Dec. 1986, 1343-1351.

Thorpe et al., "In vitro site-specific integration of bacteriophage DNA catalyzed by a recombinase of the resolvase/invertase family", *Proceedings of the National Academy of Sciences*, vol. 95, No. 10, May 1998, 5505-5510.

Tsurushita et al., "Phage display vectors for in vivo recombination of immunoglobulin heavy and light chain genes to make large combinatorial libraries", *Gene*, vol. 172, 1996, 59-63.

Uetsuki et al., "Isolation and Characterization of the Human Chromosomal Gene for Polypeptide Chain Elongation Factor-1alpha", *The Journal of Biological Chemistry*, vol. 264, No. 10, Apr. 5, 1989, 5791-5798.

Ulmanen et al., "Transcription and Translation of Foreign Genes in *Bacillus subtilis* by the Aid of a Secretion Vector", *Journal of Bacteriology*, vol. 162, No. 1, Apr. 1985, 176-182.

U.S. Appl. No. 09/177,387, Office Action mailed Jan. 25, 2001.

U.S. Appl. No. 09/177,387, Office Action mailed May 22, 2000.

U.S. Appl. No. 09/177,387, Office Action mailed Jun. 24, 1999.

U.S. Appl. No. 09/177,387, Office Action mailed Jul. 26, 2004.

U.S. Appl. No. 09/177,387, Office Action mailed Oct. 11, 2001.

U.S. Appl. No. 09/177,387, filed Oct. 23, 1998.

U.S. Appl. No. 09/177,387, Response to Jan. 25, 2001 Office Action filed Jul. 25, 2001.

U.S. Appl. No. 09/177,387, Response to Mar. 15, 1999 Office Action filed Apr. 15, 1999.

U.S. Appl. No. 09/177,387, Response to May 22, 2000 Office Action filed Aug. 22, 2000.

U.S. Appl. No. 09/177,387, Response to Sep. 24, 1999 Office Action filed Dec. 23, 1999.

U.S. Appl. No. 09/296,281, filed Apr. 22, 1999.

U.S. Appl. No. 09/432,085, Notice of Allowance mailed Jun. 28, 2007.

U.S. Appl. No. 09/432,085, Office Action mailed Jul. 16, 2004.

U.S. Appl. No. 09/432,085, Office Action mailed Feb. 7, 2007.

U.S. Appl. No. 09/432,085, Office Action mailed Jun. 16, 2005,.
U.S. Appl. No. 09/432,085, Office Action mailed Dec. 28, 2004.
U.S. Appl. No. 09/432,085, Response to Feb. 7, 2007 Notice of Non-Compliant Amendment, filed Mar. 5, 2007.
U.S. Appl. No. 09/432,085, Response to Feb. 22, 2006 Office Action filed Jul. 24, 2006.
U.S. Appl. No. 09/432,085, Supplemental Notice of Allowance Aug. 7, 2007.
U.S. Appl. No. 09/518,188, filed Mar. 2, 2000.
U.S. Appl. No. 09/648,790, filed Aug. 28, 2000.
U.S. Appl. No. 09/695,065, Office Action mailed Feb. 23, 2005.
U.S. Appl. No. 09/695,065, Office Action mailed Mar. 10, 2006.
U.S. Appl. No. 09/695,065, Office Action mailed Mar. 24, 2004.
U.S. Appl. No. 09/695,065, Office Action mailed Jul. 17, 2001.
U.S. Appl. No. 09/695,065, Office Action mailed Aug. 12, 2003.
U.S. Appl. No. 09/695,065, Office Action mailed Oct. 27, 2004.
U.S. Appl. No. 09/695,065, Office Action mailed Apr. 11, 2002.
U.S. Appl. No. 09/695,065, filed Oct. 25, 2000,.
U.S. Appl. No. 09/695,065, Response to Mar. 24, 2004 Office Action filed Jun. 23, 2004.
U.S. Appl. No. 09/695,065, Response to Apr. 11, 2002 Office Action filed Apr. 11, 2003.
U.S. Appl. No. 09/695,065, Response to May 24, 2001 Office Action filed Jun. 21, 2001.
U.S. Appl. No. 09/695,065, Response to Jul. 17, 2001 Office Action filed Jan. 17, 2002.
U.S. Appl. No. 09/695,065, Response to Aug. 12, 2003 Office Action filed Oct. 10, 2003.
U.S. Appl. No. 09/695,065, Response to Oct. 27, 2004 Office Action filed Jan. 27, 2005.
U.S. Appl. No. 09/855,797, Office Action mailed Jun. 20, 2007.
U.S. Appl. No. 09/855,797, Office Action mailed Oct. 11, 2005.
U.S. Appl. No. 09/855,797, Office Action mailed Oct. 1, 2004.
U.S. Appl. No. 09/855,797, Office Action mailed Apr. 20, 2005.
U.S. Appl. No. 09/855,797, Office Action mailed Jun. 28, 2006.
U.S. Appl. No. 09/855,797, Office Action mailed Dec. 15, 2006.
U.S. Appl. No. 09/855,797, Office Action mailed Jan. 28, 2008.
U.S. Appl. No. 09/855,797, Office Action mailed Oct. 28, 2008.
U.S. Appl. No. 09/855,797, Response to Jan. 28, 2008 Office Action filed Jul. 28, 2008.
U.S. Appl. No. 09/855,797, Response to Jun. 28, 2006 Office Action filed Sep. 28, 2006.
U.S. Appl. No. 09/855,797, Response to Oct. 11, 2005 Office Action filed Apr. 11, 2006.
U.S. Appl. No. 09/855,797, Response to Office Action filed Oct. 31, 2007.
U.S. Appl. No. 09/855,797, Response to Office Action filed Apr. 3, 2007.
U.S. Appl. No. 09/907,719, Office Action mailed Jul. 13, 2004.
U.S. Appl. No. 09/907,719, Office Action mailed Jan. 29, 2004.
U.S. Appl. No. 09/907,719, Office Action mailed Dec. 28, 2004.
U.S. Appl. No. 09/907,719, Office Action mailed Mar. 21, 2008.
U.S. Appl. No. 09/907,719, Office Action mailed Mar. 28, 2006.
U.S. Appl. No. 09/907,719, Office Action mailed Sep. 7, 2007.
U.S. Appl. No. 09/907,719, Office Action mailed Dec. 13, 2006.
U.S. Appl. No. 09/907,719, Office Action Jul. 26, 2005.
U.S. Appl. No. 09/907,719, Response to Mar. 28, 2006 Office Action, Filed on Sep. 28, 2006.
U.S. Appl. No. 09/907,719, Response to Sep. 7, 2007 Office Action, Filed on Oct. 30, 2007.
U.S. Appl. No. 09/907,719, Response to Dec. 13, 2006 Office Action, Filed on Jun. 13, 2007.
U.S. Appl. No. 09/907,719, Response to Office Action filed Apr. 29, 2004.
U.S. Appl. No. 09/984,239, filed Oct. 29, 2001.
U.S. Appl. No. 10/058,291, Office Action mailed Nov. 26, 2008.
U.S. Appl. No. 10/058,291, Office Action mailed Apr. 15, 2009.
U.S. Appl. No. 10/058,291, Office Action mailed Apr. 28, 2005.
U.S. Appl. No. 10/058,291, Office Action mailed Aug. 11, 2006.
U.S. Appl. No. 10/058,291, Office Action mailed Sep. 22, 2004.
U.S. Appl. No. 10/058,291, Office Action mailed Oct. 21, 2005.
U.S. Appl. No. 10/058,291, Response to Aug. 11, 2006 Office Action filed Feb. 13, 2007.
U.S. Appl. No. 10/058,291, Response to Oct. 21, 2005 Office Action filed Jun. 20, 2006.
U.S. Appl. No. 10/058,291, Restriction Requirement mailed Apr. 15, 2009.
U.S. Appl. No. 10/058,292, Office Action mailed May 26, 2005.
U.S. Appl. No. 10/058,292, Office Action mailed Aug. 9, 2006.
U.S. Appl. No. 10/058,292, Office Action mailed Sep. 22, 2004.
U.S. Appl. No. 10/058,292, Office Action mailed Nov. 18, 2005.
U.S. Appl. No. 10/058,292, Response to Aug. 9, 2006 Office Action filed Feb. 9, 2007.
U.S. Appl. No. 10/058,292, Response to Nov. 18, 2005 Office Action filed May 18, 2006.
U.S. Appl. No. 10/151,690, Office Action mailed Apr. 18, 2005.
U.S. Appl. No. 10/162,879, Office Action mailed Mar. 24, 2008.
U.S. Appl. No. 10/162,879, Office Action mailed Apr. 28, 2005.
U.S. Appl. No. 10/162,879, Office Action mailed Jun. 18, 2007.
U.S. Appl. No. 10/162,879, Office Action mailed Oct. 3, 2006.
U.S. Appl. No. 10/162,879, Office Action mailed Oct. 20, 2005.
U.S. Appl. No. 10/162,879, Response to Oct. 3, 2006 and Jun. 18, 2007 Office Actions filed on Dec. 18, 2007.
U.S. Appl. No. 10/162,879, Response to Oct. 3, 2006 Office Action filed on Apr. 2, 2007.
U.S. Appl. No. 10/162,879, Response to Oct. 20, 2005 Office Action, Filed on Jun. 20, 2006.
U.S. Appl. No. 10/454,793, filed Jun. 5, 2001.
U.S. Appl. No. 10/796,868, Office Action mailed Jan. 25, 2005.
U.S. Appl. No. 10/820,133, Office Action mailed Nov. 17, 2004.
U.S. Appl. No. 11/000,371, Office Action mailed Feb. 5, 2009.
U.S. Appl. No. 11/612,445, Office Action mailed Jun. 1, 2009.
U.S. Appl. No. 11/612,957, Office Action mailed Jun. 1, 2009.
Van Den Berg et al., "Serial analysis of gene expression: rapid RT-PCR analysis of unknown SAGE tags", *Nucleic Acids Research*, vol. 27, No. 17, 1999, i-iii.
Van Deursen et al., "Cre-mediated site-specific translocation between nonhomologous mouse chromosomes"*Proceedings of the National Academy of Sciences*, vol. 92, Aug. 1995, 7376-7380.
Vanin et al., "Development of High-Titer Retroviral Producer Cell Lines by Using Cre-Mediated Recombination", *Journal of Virology*, vol. 71, No. 10, Oct. 1997, 7820-7826.
Venkatesh et al., "Ribosomal Protein S1 and NusA Protein Complexed to Recombination protein beta of Phage lambda", *Journal of Bacteriology*, vol. 175, No. 6, Mar. 1993, 1844-1846.
Voss et al., "The Role of Enhancers in the Regulation of Cell-type-specific Transcriptional Control", *Trends Biochem. Sci.*, vol. 11, Elsevier Science, Jul. 1986, 287-289.
Voziyanov et al., "A general model for site-specific recombination by the integrase family recombinases", *Nucleic Acids Research*, vol. 27, No. 4, 1999, 930-941.
Walhout, "Gateway Recombinational cloning: Application to the cloning of large numbers of open reading frames or ORFeomes", *Methods in Enzymology*, vol. 328, Jan. 1, 2000, 575-592.
Walhout, "Protein Interaction Mapping in *C. elegans* Using Proteins Involved in Vulval Development", *Science*, vol. 287, Jan. 7, 2000, 116-122.
Wang, Gan et al., "pDUAL: A transpoon-based cosmid cloning vector for generating nested deletions and DNA sequencing templates in vivo", *Proceedings of the National Academy of Sciences*, vol. 90, Aug. 1993, 7874-7878.
Wang et al., "Targeted DNA recombination in vivo using an adenovirus carrying the cre recombinase gene", *Proceedings of the National Academy of Sciences*, vol. 93, Apr. 1996, 3932-3936.
Ward et al., "Construction and characterisation of a series of multi-copy promoter-probe plasmid vectors for *Streptomyces* using the aminoglycoside phosphotransferase gene from Tn5 as indicator", *Molecular and General Genetics*, vol. 203, 1986, 468-478.
Wasserman et al., "The helical repeat of double-stranded DNA varies as a function of catenation and supercoiling", *Nature*, vol. 334, No. 4, Aug. 1988, 448-450.
Waterhouse et al., "Combinatorial infection and in vivo recombination: a strategy for making large phage antibody repertoires", *Nucleic Acids Research*, vol. 21, No. 9, 1993, 2265-2266.

Weisberg et al., "Site-specific Recombination in Phage Lambda", *Lambda II*, Hendrix, R.W., et al., eds., Cold Spring Harbor Laboratory, Cold Spring Harbor, NY, 1983, 211-250.

Wierzbicki et al., "A Mutational Analysis of the Bacteriophage P1 Recombinase Cre", *Journal of Molecular Biology*, vol. 195, 1987, 785-794.

Wild et al., "A broad-host-range in vivo pop-out and amplification system for generating large quantities of 50- to 100-kb genomic fragments for direct DNA sequencing", *Gene*, vo. 179, 1996, 181-188.

Wild et al., "Targeting and retrofitting pre-existing libraries of transposon insertions with FRT and oriV elements for in-vivo generation of large quantities of any genomic fragment", *Gene*, vol. 223, 1998, 55-66.

Winoto et al., "Directional Control of Site-specific Recombintation by Bacteriophage lambda: Evidence that a Binding Site for Int Protein Far from the Crossover Point is Required for Integrative but not Excisive Recombination", *Journal of Molecular Biology*, vol. 192, 1986, 677-680.

Wittman, "Components of Bacterial Ribosomes", *Annual Review of Biochemistry*, vol. 51, Annual Reviews, Inc., 1982, 155-183.

Wittmann, H. G., "Architecture of Prokaryotic Ribosomes", *Annual Review of Biochemistry*, vol. 52, Annual Reviews, Inc., 1983, 35-65.

Yang et al., "Site-specific recombination in plane view", *Structure*, vol. 5, No. 11, Nov. 15, 1997, 1401-1406.

Yanisch-Perron et al., "Improved M13 phage cloning vectors and host strains: nucleotide sequences of the M13mp18 and pUC19 vectors", *Gene*, vol. 33, Science, 1985, 103-119.

Yoon et al., "SSL1, a Suppressor of a HIS4 5'-UTR Stem-loop Mutation, is Essential for Translation Initiation and Affects UV Resistance in Yeast", *Genes and Development*, vol. 6, 1992, 2463-2477.

Yoon et al., "Cre/loxP-mediated in vivo excision of large segments from yeast genome and their amplification based on the 2 .mu.m plasmid-derived system", *Gene*, vol. 223, 1998, 67-76.

York et al., "Simple and efficient generation in vitro of nested deletions and inversions: Tn5 intramolecular transposition", *Nucleic Acids Research*, vol. 26, No. 8, 1998, 1927-1933.

Zahra et al., "Selectable in-vivo recombination to Increase Antibody Library Size—an Improved Phage Display Vector System", *Gene*, vol. 227, 1999, 49-54.

Zechiedrich et al., "Topoisomerase IV, not gyrase, decatenates products of site-specific recombination in *Escherichia coli*", *Genes & Development*, vol. 11, 1997, 2580-2592.

Zhang et al., "A new logic for DNA engineering using recombination in *Escherichia coli*", *Nature Genetics*, vol. 20, No. 2, Oct. 1998, 123-128.

Zhu et al., "Homology requirements for ligation and strand exchange by the FLP recombinase", *The Journal of Biological Chemistry*, vol. 270, No. 19, May 12, 1995, 11646-11653.

Zucman-Rossi et al., "Chromosome translocation based on ilegitimate recombination in human tumors", *Proceedings of the National Academy of Sciences*, vol. 95, No. 20, Sep. 29, 1998, 11786-11791.

Zucman-Rossi et al., "*H. sapiens* EWS gene, 5' part and flanking region", GenBank Accession No. Y08806, Nov. 1996.

\* cited by examiner

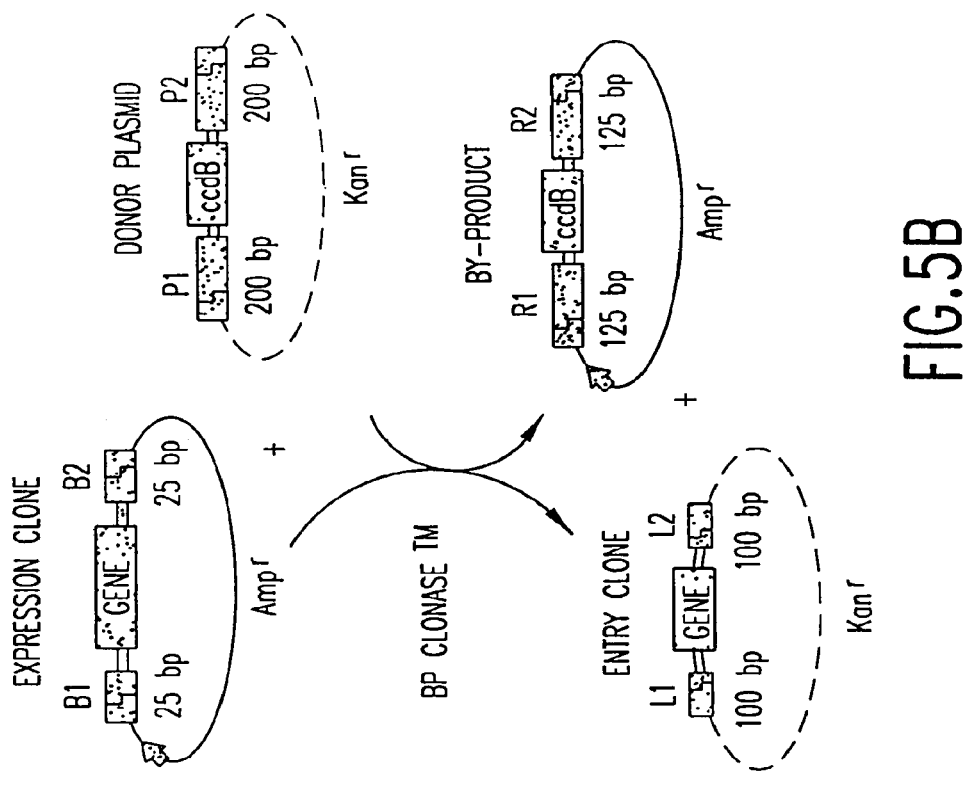
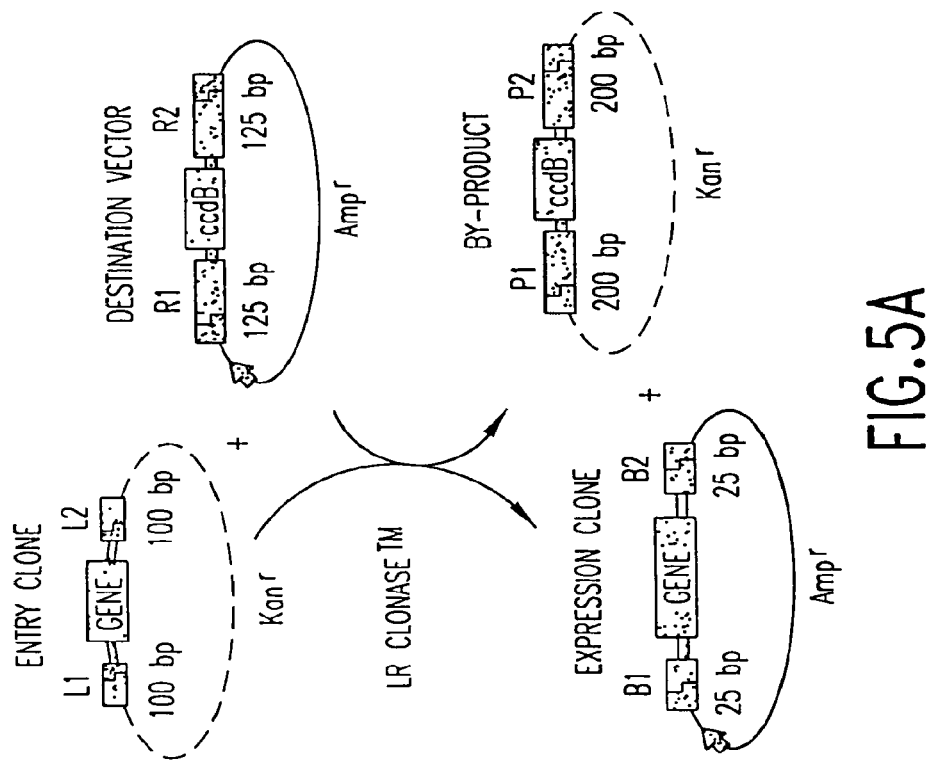
FIG.5B
FIG.5A

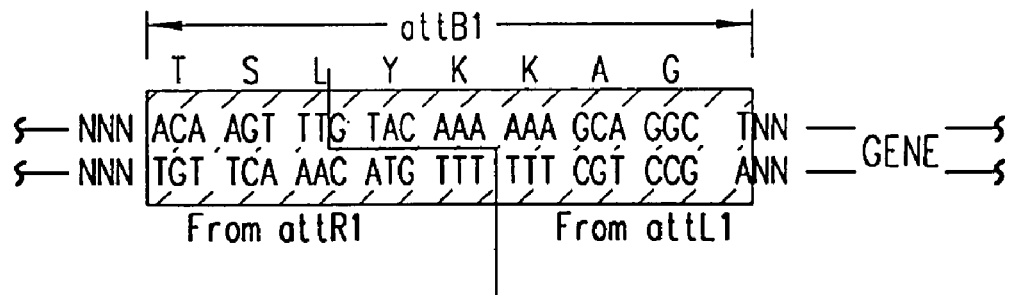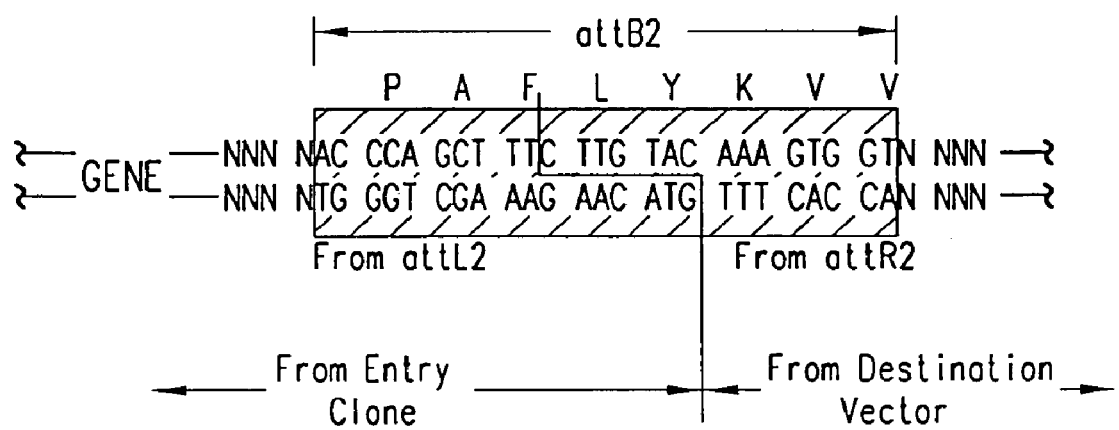
FIG.6

Recombination Site Nucleotide Sequences attB1: 5'-ACAAGTTTGTACAAAAAAGCAGGCT-3' attB2: 5'-ACCCAGCTTTCTTGTACAAAGTGGT-3' attP1: 5'-TACAGGTCACTAATACCATCTAAGTAGTTGATTCATAGTGACTGGATATG-
TTGTGTTTTACAGTATTATGTAGTCTGTTTTTTATGCAAAATCTAATTTA-
ATATATTGATATTTATATCATTTTACGTTTCTCGTTCAGCTTTTTTGTAC-
AAAGTTGGCATTATAAAAAAGCATTGCTCATCAATTTGTTGCAACGAACA-
GGTCACTATCAGTCAAAATAAAATCATTATTTG-3' attP2: 5'-CAAATAATGATTTTATTTTGACTGATAGTGACCTGTTCGTTGCAACAAAT-
TGATAAGCAATGCTTTCTTATAATGCCAACTTTGTACAAGAAAGCTGAAC-
GAGAAACGTAAAATGATATAAATATCAATATATTAAATTAGATTTTGCAT-
AAAAAACAGACTACATAATACTGTAAAACACAACATATCCAGTCACTATGA-
ATCAACTACTTAGATGGTATTAGTGACCTGTA-3' attR1: 5'-ACAAGTTTGTACAAAAAAGCTGAACGAGAAACGTAAAATGATATAAA-
TATCAATATATTAAATTAGATTTTGCATAAAAAACAGACTACATAATAC-
TGTAAAACACAACATATCCAGTCACTATG-3' attR2: 5'-GCAGGTCGACCATAGTGACTGGATATGTTGTGTTTTACAGTATTAT-
GTAGTCTGTTTTTTATGCAAAATCTAATTTAATATATTGATATTT-
ATATCATTTTACGTTTCTCGTTCAGCTTTCTTGTACAAAGTGGT-3' attL1: 5'-CAAATAATGATTTTATTTTGACTGATAGTGACCTGTTCGTTGCAAC-
AAATTGATAAGCAATGCTTTTTTATAATGCCAACTTTGTACAAAAAA-GCAGGCT-3' attL2: 5'-CAAATAATGATTTTATTTTGACTGATAGTGACCTGTTCGTTGCAACAA-
ATTGATAAGCAATGCTTTCTTATAATGCCAACTTTGTACAAGAAAGCTGGGT-3'

FIG.9 pENTR1A 2717 bp

| Base Nos. | Gene Encoded |
|---|---|
| 67..166 | attL1 |
| 321..626 | ccdB |
| 655..754 | attL2 |
| 877..1686 | KmR |
| 1791..2364 | ori |

```
   1 CTGACGGATG GCCTTTTTGC GTTTCTACAA ACTCTTCCTG TTAGTTAGTT ACTTAAGCTC
  61 GGGCCCCAAA TAATGATTTT ATTTTGACTG ATAGTGACCT GTTCGTTGCA ACAAATTGAT
 121 AAGCAATGCT TTTTTATAAT GCCAACTTTG TACAAAAAAG CAGGCTTTAA AGGAACCAAT
 181 TCAGTCGACT GGATCCGGTA CCGAATTCGC TTACTAAAAG CCAGATAACA GTATGCGTAT
 241 TTGCGCGCTG ATTTTTGCGG TATAAGAATA TATACTGATA TGTATACCCG AAGTATGTCA
 301 AAAAGAGGTG TGCTTCTAGA ATGCAGTTTA AGGTTTACAC CTATAAAAGA GAGAGCCGTT
 361 ATCGTCTGTT TGTGGATGTA CAGAGTGATA TTATTGACAC GCCCGGGCGA CGGATAGTGA
 421 TCCCCCTGGC CAGTGCACGT CTGCTGTCAG ATAAAGTCTC CCGTGAACTT TACCCGGTGG
 481 TGCATATCGG GGATGAAAGC TGGCGCATGA TGACCACCGA TATGGCCAGT GTGCCGGTCT
 541 CCGTTATCGG GGAAGAAGTG GCTGATCTCA GCCACCGCGA AAATGACATC AAAAACGCCA
 601 TTAACCTGAT GTTCTGGGGA ATATAGAATT CGCGGCCGCA CTCGAGATAT CTAGACCCAG
 661 CTTTCTTGTA CAAAGTTGGC ATTATAAGAA AGCATTGCTT ATCAATTTGT TGCAACGAAC
 721 AGGTCACTAT CAGTCAAAAT AAAATCATTA TTTGCCATCC AGCTGCAGCT CTGGCCCGTG
 781 TCTCAAAATC TCTGATGTTA CATTGCACAA GATAAAAATA TATCATCATG AACAATAAAA
 841 CTGTCTGCTT ACATAAACAG TAATACAAGG GGTGTTATGA GCCATATTCA ACGGGAAACG
 901 TCGAGGCCGC GATTAAATTC CAACATGGAT GCTGATTTAT ATGGGTATAA ATGGGCTCGC
 961 GATAATGTCG GGCAATCAGG TGCGACAATC TATCGCTTGT ATGGGAAGCC CGATGCGCCA
1021 GAGTTGTTTC TGAAACATGG CAAAGGTAGC GTTGCCAATG ATGTTACAGA TGAGATGGTC
1081 AGACTAAACT GGCTGACGGA ATTTATGCCT CTTCCGACCA TCAAGCATTT TATCCGTACT
1141 CCTGATGATG CATGGTTACT CACCACTGCG ATCCCCGGAA AAACAGCATT CCAGGTATTA
1201 GAAGAATATC CTGATTCAGG TGAAAATATT GTTGATGCGC TGGCAGTGTC CCTGCGCCGG
1261 TTGCATTCGA TTCCTGTTTG TAATTGTCCT TTTAACAGCG ATCGCGTATT TCGTCTCGCT
1321 CAGGCGCAAT CACGAATGAA TAACGGTTTG GTTGATGCGA GTGATTTTGA TGACGAGCGT
1381 AATGGCTGGC CTGTTGAACA AGTCTGGAAA GAAATGCATA AACTTTTGCC ATTCTCACCG
1441 GATTCAGTCG TCACTCATGG TGATTTCTCA CTTGATAACC TTATTTTTGA CGAGGGGAAA
1501 TTAATAGGTT GTATTGATGT TGGACGAGTC GGAATCGCAG ACCGATACCA GGATCTTGCC
1561 ATCCTATGGA ACTGCCTCGG TGAGTTTTCT CCTTCATTAC AGAAACGGCT TTTTCAAAAA
1621 TATGGTATTG ATAATCCTGA TATGAATAAA TTGCAGTTTC ATTTGATGCT CGATGAGTTT
1681 TTCTAATCAG AATTGGTTAA TTGGTTGTAA CATTATTCAG ATTGGGCCCC GTTCCACTGA
1741 GCGTCAGACC CCGTAGAAAA GATCAAAGGA TCTTCTTGAG ATCCTTTTTT TCTGCGCGTA
1801 ATCTGCTGCT TGCAAACAAA AAAACCACCG CTACCAGCGG TGGTTTGTTT GCCGGATCAA
1861 GAGCTACCAA CTCTTTTTCC GAAGGTAACT GGCTTCAGCA GAGCGCAGAT ACCAAATACT
1921 GTTCTTCTAG TGTAGCCGTA GTTAGGCCAC CACTTCAAGA ACTCTGTAGC ACCGCCTACA
1981 TACCTCGCTC TGCTAATCCT GTTACCAGTG GCTGCTGCCA GTGGCGATAA GTCGTGTCTT
2041 ACCGGGTTGG ACTCAAGACG ATAGTTACCG GATAAGGCGC AGCGGTCGGG CTGAACGGGG
2101 GGTTCGTGCA CACAGCCCAG CTTGGAGCGA ACGACCTACA CCGAACTGAG ATACCTACAG
2161 CGTGAGCTAT GAGAAAGCGC CACGCTTCCC GAAGGGAGAA AGGCGGACAG GTATCCGGTA
2221 AGCGGCAGGG TCGGAACAGG AGAGCGCACG AGGGAGCTTC CAGGGGGAAA CGCCTGGTAT
2281 CTTTATAGTC CTGTCGGGTT TCGCCACCTC TGACTTGAGC GTCGATTTTT GTGATGCTCG
2341 TCAGGGGGGC GGAGCCTATG GAAAAACGCC AGCAACGCGG CCTTTTTACG GTTCCTGGCC
2401 TTTTGCTGGC CTTTTGCTCA CATGTTCTTT CCTGCGTTAT CCCCTGATTC TGTGGATAAC
2461 CGTATTACCG CTAGCATGGA TCTCGGGGAC GTCTAACTAC TAAGCGAGAG TAGGGAACTG
2521 CCAGGCATCA AATAAAACGA AAGGCTCAGT CGGAAGACTG GGCCTTTCGT TTTATCTGTT
2581 GTTTGTCGGT GAACGCTCTC CTGAGTAGGA CAAATCCGCC GGGAGCGGAT TTGAACGTTG
2641 TGAAGCAACG GCCCGGAGGG TGGCGGGCAG GACGCCCGCC ATAAACTGCC AGGCATCAAA
2701 CTAAGCAGAA GGCCATC
```

FIG.10B

Cloning Sites of the Entry Vector pENTR2B (reading frame B)

```
    Int    attL1              EheI      XmnI     SalI      BamHI
   TTG TAC AAA AAA GCA GGC TGG CGC CGG AAC CAA TTC AGT CGA CTG GAT CCG
   AAC ATG TTT TTT CGT CCG ACC GCG GCC TTG GTT AAG TCA GCT GAC CTA GGC
   Leu Tyr Lys Lys Ala Gly Trp Arg Arg Asn Gln Phe Ser Arg Leu Asp Pro KpnI EcoRI              EcoRI    NotI         XhoI EcoRV XbaI
   GTA CCG AAT TC- ccdB - - G AAT TCG CGG CCG CAC TCG AGA TAT CTA GAC CCA
   CAT GGC TTA AG             C TTA AGC GCC GGC GTG AGC TCT ATA GAT CTG GGT
   Val Pro Asn                  Asn Ser Arg Pro His Ser Arg Tyr Leu Asp Pro Int      attL2
   GCT TTC TTG TAC AAA G
   CGA AAG AAC ATG TTT C Ala Phe Leu Tyr Lys
```

FIG.11A pENTR2B 2718 bp

| Location (Base Nos.) | Gene Encoded |
|---|---|
| 67..166 | attL1 |
| 322..627 | ccdB |
| 656..755 | attL2 |
| 878..1687 | KmR |
| 1792..2365 | ori |

```
   1 CTGACGGATG GCCTTTTTGC GTTTCTACAA ACTCTTCCTG TTAGTTAGTT ACTTAAGCTC
  61 GGGCCCCAAA TAATGATTTT ATTTTGACTG ATAGTGACCT GTTCGTTGCA ACAAATTGAT
 121 AAGCAATGCT TTTTTATAAT GCCAACTTTG TACAAAAAAG CAGGCTGGCG CCGGAACCAA
 181 TTCAGTCGAC TGGATCCGGT ACCGAATTCG CTTACTAAAA GCCAGATAAC AGTATGCGTA
 241 TTTGCGCGCT GATTTTTGCG GTATAAGAAT ATATACTGAT ATGTATACCC GAAGTATGTC
 301 AAAAAGAGGT GTGCTTCTAG AATGCAGTTT AAGGTTTACA CCTATAAAAG AGAGAGCCGT
 361 TATCGTCTGT TTGTGGATGT ACAGAGTGAT ATTATTGACA CGCCCGGGCG ACGGATGGTG
 421 ATCCCCCTGG CCAGTGCACG TCTGCTGTCA GATAAAGTCT CCCGTGAACT TTACCCGGTG
 481 GTGCATATCG GGGATGAAAG CTGGCGCATG ATGACCACCG ATATGGCCAG TGTGCCGGTC
 541 TCCGTTATCG GGGAAGAAGT GGCTGATCTC AGCCACCGCG AAAATGACAT CAAAAACGCC
 601 ATTAACCTGA TGTTCTGGGG AATATAGAAT TCGCGGCCGC ACTCGAGATA TCTAGACCCA
 661 GCTTTCTTGT ACAAAGTTGG CATTATAAGA AAGCATTGCT TATCAATTTG TTGCAACGAA
 721 CAGGTCACTA TCAGTCAAAA TAAAATCATT ATTTGCCATC CAGCTGCAGC TCTGGCCCGT
 781 GTCTCAAAAT CTCTGATGTT ACATTGCACA AGATAAAAAT ATATCATCAT GAACAATAAA
 841 ACTGTCTGCT TACATAAACA GTAATACAAG GGGTGTTATG AGCCATATTC AACGGGAAAC
 901 GTCGAGGCCG CGATTAAATT CCAACATGGA TGCTGATTTA TATGGGTATA AATGGGCTCG
 961 CGATAATGTC GGGCAATCAG GTGCGACAAT CTATCGCTTG TATGGGAAGC CCGATGCGCC
1021 AGAGTTGTTT CTGAAACATG GCAAAGGTAG CGTTGCCAAT GATGTTACAG ATGAGATGGT
1081 CAGACTAAAC TGGCTGACGG AATTTATGCC TCTTCCGACC ATCAAGCATT TTATCCGTAC
1141 TCCTGATGAT GCATGGTTAC TCACCACTGC GATCCCCGGA AAAACAGCAT TCCAGGTATT
1201 AGAAGAATAT CCTGATTCAG GTGAAAATAT TGTTGATGCG CTGGCAGTGT TCCTGCGCCG
1261 GTTGCATTCG ATTCCTGTTT GTAATTGTCC TTTTAACAGC GATCGCGTAT TCGTCTCGC
1321 TCAGGCGCAA TCACGAATGA ATAACGGTTT GGTTGATGCG AGTGATTTTG ATGACGAGCG
1381 TAATGGCTGG CCTGTTGAAC AAGTCTGGAA AGAAATGCAT AAACTTTTGC CATTCTCACC
1441 GGATTCAGTC GTCACTCATG GTGATTTCTC ACTTGATAAC CTTATTTTTG ACGAGGGGAA
1501 ATTAATAGGT TGTATTGATG TTGGACGAGT CGGAATCGCA GACCGATACC AGGATCTTGC
1561 CATCCTATGG AACTGCCTCG GTGAGTTTTC TCCTTCATTA CAGAAACGGC TTTTTCAAAA
1621 ATATGGTATT GATAATCCTG ATATGAATAA ATTGCAGTTT CATTTGATGC TCGATGAGTT
1681 TTTCTAATCA GAATTGGTTA ATTGGTTGTA ACATTATTCA GATTGGGCCC CGTTCCACTG
1741 AGCGTCAGAC CCCGTAGAAA AGATCAAAGG ATCTTCTTGA GATCCTTTTT TTCTGCGCGT
1801 AATCTGCTGC TTGCAAACAA AAAAACCACC GCTACCAGCG GTGGTTTGTT TGCCGGATCA
1861 AGAGCTACCA ACTCTTTTTC CGAAGGTAAC TGGCTTCAGC AGAGCGCAGA TACCAAATAC
1921 TGTTCTTCTA GTGTAGCCGT AGTTAGGCCA CCACTTCAAG AACTCTGTAG CACCGCCTAC
1981 ATACCTCGCT CTGCTAATCC TGTTACCAGT GGCTGCTGCC AGTGGCGATA AGTCGTGTCT
2041 TACCGGGTTG GACTCAAGAC GATAGTTACC GGATAAGGCG CAGCGGTCGG GCTGAACGGG
2101 GGGTTCGTGC ACACAGCCCA GCTTGGAGCG AACGACCTAC ACCGAACTGA GATACCTACA
2161 GCGTGAGCTA TGAGAAAGCG CCACGCTTCC CGAAGGGAGA AAGGCGGACA GGTATCCGGT
2221 AAGCGGCAGG GTCGGAACAG GAGAGCGCAC GAGGGAGCTT CCAGGGGGAA ACGCCTGGTA
2281 TCTTTATAGT CCTGTCGGGT TTCGCCACCT CTGACTTGAG CGTCGATTTT TGTGATGCTC
2341 GTCAGGGGGG CGGAGCCTAT GGAAAAACGC CAGCAACGCG GCCTTTTTAC GGTTCCTGGC
2401 CTTTTGCTGG CCTTTTGCTC ACATGTTCTT TCCTGCGTTA TCCCCTGATT CTGTGGATAA
2461 CCGTATTACC GCTACGATGG ATCTCGGGGA CGTCTAACTA CTAAGCGAGA GTAGGGAACT
2521 GCCAGGCATC AAATAAAACG AAAGGCTCAG TCGGAAGACT GGGCCTTTCG TTTTATCTGT
2581 TGTTTGTCGG TGAACGCTCT CCTGAGTAGG ACAAATCCGC CGGGAGCGGA TTTGAACGTT
2641 GTGAAGCAAC GGCCCGGAGG GTGGCGGGCA GGACGCCCGC CATAAACTGC CAGGCATCAA
2701 ACTAAGCAGA AGGCCATC
```

FIG.11B

Cloning Sites of the Entry Vector pENTR3C (reading frame C)

```
    Int  attL1                    DraI      XmnI       SalI    BamHI
┌────────────────────────┬─────────────────────────┬──────────────────────┐
│TTG TAC AAA AAA GCA GGC │TCT TTA AAG GAA CCA ATT CAG│TCG ACT GGA TCC GGT│
│AAC ATG TTT TTT CGT CCG │AGA AAT TTC CTT GGT TAA GTC AGC│TGA CCT AGG CCA│
└────────────────────────┴─────────────────────────┴──────────────────────┘
 Leu Tyr Lys Lys Ala Gly Ser Leu Lys Glu Pro Ile Gln Ser Thr Gly Ser Gly KpnI  EcoRI    PvuI              EcoRI      NotI      XhoI    EcoRV  XbaI
 ACC GAA TTC GAT CGC--ccdB--G│AAT TCG CGG CCG CAC│TCG AGA TAT│CTA
 TGG CTT AAG CTA GCG          C TTA AGC GCC GGC GTG AGC TCT ATA GAT
 Thr Glu Phe                     Asn Ser Arg Pro His Ser Arg Tyr Leu attL2    Int
 GAC CCA GCT TTC TTG TAC AAA G
 CTG GGT CGA AAG AAC ATG TTT C
 Asp Pro Ala Phe Leu Tyr Lys
```

FIG.12A pENTR3C 2723 bp

| Location (Base Nos.) | Gene Encoded |
|---|---|
| 67..166 | attL1 |
| 327..632 | ccdB |
| 661..760 | attL2 |
| 883..1692 | KmR |
| 1797..2370 | ori |

```
   1 CTGACGGATG GCCTTTTTGC GTTTCTACAA ACTCTTCCTG TTAGTTAGTT ACTTAAGCTC
  61 GGGCCCCAAA TAATGATTTT ATTTTGACTG ATAGTGACCT GTTCGTTGCA ACAAATTGAT
 121 AAGCAATGCT TTTTTATAAT GCCAACTTTG TACAAAAAAG CAGGCTCTTT AAAGGAACCA
 181 ATTCAGTCGA CTGGATCCGG TACCGAATTC GATCGCTTAC TAAAAGCCAG ATAACAGTAT
 241 GCGTATTTGC GCGCTGATTT TTGCGGTATA AGAATATATA CTGATATGTA TACCCGAAGT
 301 ATGTCAAAAA GAGGTGTGCT TCTAGAATGC AGTTTAAGGT TTACACCTAT AAAAGAGAGA
 361 GCCGTTATCG TCTGTTTGTG GATGTACAGA GTGATATTAT TGACACGCCC GGGCGACGGA
 421 TGGTGATCCC CCTGGCCAGT GCACGTCTGC TGTCAGATAA AGTCTCCCGT GAACTTTACC
 481 CGGTGGTGCA TATCGGGGAT GAAAGCTGGC GCATGATGAC CACCGATATG GCCAGTGTGC
 541 CGGTCTCCGT TATCGGGGAA GAAGTGGCTG ATCTCAGCCA CCGCGAAAAT GACATCAAAA
 601 ACGCCATTAA CCTGATGTTC TGGGGAATAT AGAATTCGCG GCCGCACTCG AGATATCTAG
 661 ACCCAGCTTT CTTGTACAAA GTTGGCATTA TAAGAAAGCA TTGCTTATCA ATTTGTTGCA
 721 ACGAACAGGT CACTATCAGT CAAAATAAAA TCATTATTTG CCATCCAGCT GCAGCTCTGG
 781 CCCGTGTCTC AAAATCTCTG ATGTTACATT GCACAAGATA AAAATATATC ATCATGAACA
 841 ATAAAACTGT CTGCTTACAT AAACAGTAAT ACAAGGGGTG TTATGAGCCA TATTCAACGG
 901 GAAACGTCGA GGCCGCGATT AAATTCCAAC ATGGATGCTG ATTTATATGG GTATAAATGG
 961 GCTCGCGATA ATGTCGGGCA ATCAGGTGCG ACAATCTATC GCTTGTATGG GAAGCCCGAT
1021 GCGCCAGAGT TGTTTCTGAA ACATGGCAAA GGTAGCGTTG CCAATGATGT TACAGATGAG
1081 ATGGTCAGAC TAAACTGGCT GACGGAATTT ATGCCTCTTC CGACCATCAA GCATTTTATC
1141 CGTACTCCTG ATGATGCATG GTTACTCACC ACTGCGATCC CCGGAAAAAC AGCATTCCAG
1201 GTATTAGAAG AATATCCTGA TTCAGGTGAA AATATTGTTG ATGCGCTGGC AGTGTTCCTG
1261 CGCCGGTTGC ATTCGATTCC TGTTTGTAAT TGTCCTTTTA ACAGCGATCG CGTATTTCGT
1321 CTCGCTCAGG CGCAATCACG AATGAATAAC GGTTTGGTTG ATGCGAGTGA TTTTGATGAC
1381 GAGCGTAATG GCTGGCCTGT TGAACAAGTC TGGAAAGAAA TGCATAAACT TTTGCCATTC
1441 TCACCGGATT CAGTCGTCAC TCATGGTGAT TTCTCACTTG ATAACCTTAT TTTTGACGAG
1501 GGGAAATTAA TAGGTTGTAT TGATGTTGGA CGAGTCGGAA TCGCAGACCG ATACCAGGAT
1561 CTTGCCATCC TATGGAACTG CCTCGGTGAG TTTTCTCCTT CATTACAGAA ACGGCTTTTT
1621 CAAAAATATG GTATTGATAA TCCTGATATG AATAAATTGC AGTTTCATTT GATGCTCGAT
1681 GAGTTTTTCT AATCAGAATT GGTTAATTGG TTGTAACATT ATTCAGATTG GGCCCCGTTC
1741 CACTGAGCGT CAGACCCCGT AGAAAAGATC AAAGGATCTT CTTGAGATCC TTTTTTTCTG
1801 CGCGTAATCT GCTGCTTGCA AACAAAAAAA CCACCGCTAC CAGCGGTGGT TTGTTTGCCG
1861 GATCAAGAGC TACCAACTCT TTTTCCGAAG GTAACTGGCT TCAGCAGAGC GCAGATACCA
1921 AATACTGTTC TTCTAGTGTA GCCGTAGTTA GGCCACCACT TCAAGAACTC TGTAGCACCG
1981 CCTACATACC TCGCTCTGCT AATCCTGTTA CCAGTGGCTG CTGCCAGTGG CGATAAGTCG
2041 TGTCTTACCG GGTTGGACTC AAGACGATAG TTACCGGATA AGGCGCAGCG GTCGGGCTGA
2101 ACGGGGGGTT CGTGCACACA GCCCAGCTTG GAGCGAACGA CCTACACCGA ACTGAGATAC
2161 CTACAGCGTG AGCTATGAGA AAGCGCCACG CTTCCCGAAG GGAGAAAGGC GGACAGGTAT
2221 CCGGTAAGCG GCAGGGTCGG AACAGGAGAG CGCACGAGGG AGCTTCCAGG GGGAAACGCC
2281 TGGTATCTTT ATAGTCCTGT CGGGTTTCGC CACCTCTGAC TTGAGCGTCG ATTTTTGTGA
2341 TGCTCGTCAG GGGGCGGAG CCTATGGAAA AACGCCAGCA ACGCGGCCTT TTTACGGTTC
2401 CTGGCCTTTT GCTGGCCTTT TGCTCACATG TTCTTTCCTG CGTTATCCCC TGATTCTGTG
2461 GATAACCGTA TTACCGCTAG CATGGATCTC GGGACGTCT AACTACTAAG CGAGAGTAGG
2521 GAACTGCCAG GCATCAAATA AAACGAAAGG CTCAGTCGGA AGACTGGGCC TTTCGTTTTA
2581 TCTGTTGTTT GTCGGTGAAC GCTCTCCTGA GTAGGACAAA TCCGCCGGGA GCGGATTTGA
2641 ACGTTGTGAA GCAACGGCCC GGAGGGTGGC GGGCAGGACG CCCGCCATAA ACTGCCAGGC
2701 ATCAAACTAA GCAGAAGGCC ATC
```

FIG.12B

Cloning Sites of the Entry Vector pENTR4

```
Int    attL1                      NcoI    Kozak XmnI    SalI    BamHI
TTG TAC AAA AAA GCA GGC TCC ACC ATG GGA ACC AAT TCA GTC GAC TGG ATC CGG
AAC ATG TTT TTT CGT CCG AGG TGG TAC CCT TGG TTA AGT CAG CTG ACC TAG GCC Leu Tyr Lys Lys Ala Gly Ser Thr Met Gly Thr Asn Ser Val Asp Trp Ile Arg KpnI EcoRI            EcoRI    NotI          XhoI EcoRV    XbaI
TAC CGA ATT C- -ccdB - -G AAT TCG CGG CCG CAC TCG AGA TAT CTA GAC CCA GCT
ATG GCT TAA G         C TTA AGC GCC GGC GTG AGC TCT ATA GAT CTG GGT CGA Tyr Arg Ile              Asn Ser Arg Pro His Ser Arg Tyr Leu Asp Pro Ala Int   attL2
TTC TTG TAC AAA G
AAG AAC ATG TTT C Phe Leu Tyr Lys
```

FIG.13A pENTR4 2720 bp

| Location (Base Nos.) | Gene Encoded |
|---|---|
| 67..166 | attL1 |
| 324..629 | ccdB |
| 658..757 | attL2 |
| 880..1689 | KmR |
| 1794..2367 | ori |

```
   1 CTGACGGATG GCCTTTTTGC GTTTCTACAA ACTCTTCCTG TTAGTTAGTT ACTTAAGCTC
  61 GGGCCCCAAA TAATGATTTT ATTTTGACTG ATAGTGACCT GTTCGTTGCA ACAAATTGAT
 121 AAGCAATGCT TTTTTATAAT GCCAACTTTG TACAAAAAAG CAGGCTCCAC CATGGGAACC
 181 AATTCAGTCG ACTGGATCCG GTACCGAATT CGCTTACTAA AAGCCAGATA ACAGTATGCG
 241 TATTTGCGCG CTGATTTTTG CGGTATAAGA ATATATACTG ATATGTATAC CCGAAGTATG
 301 TCAAAAAGAG GTGTGCTTCT AGAATGCAGT TTAAGGTTTA CACCTATAAA AGAGAGAGCC
 361 GTTATCGTCT GTTTGTGGAT GTACAGAGTG ATATTATTGA CACGCCCGGG CGACGGATGG
 421 TGATCCCCCT GGCCAGTGCA CGTCTGCTGT CAGATAAAGT CTCCCGTGAA CTTTTACCCGG
 481 TGGTGCATAT CGGGGATGAA AGCTGGCGCA TGATGACCAC CGATATGGCC AGTGTGCCGG
 541 TCTCCGTTAT CGGGGAAGAA GTGGCTGATC TCAGCCACCG CGAAAATGAC ATCAAAAACG
 601 CCATTAACCT GATGTTCTGG GGAATATAGA ATTCGCGGCC GCACTCGAGA TATCTAGACC
 661 CAGCTTTCTT GTACAAAGTT GGCATTATAA GAAAGCATTG CTTATCAATT TGTTGCAACG
 721 AACAGGTCAC TATCAGTCAA AATAAAATCA TTATTTGCCA TCCAGCTGCA GCTCTGGCCC
 781 GTGTCTCAAA ATCTCTGATG TTACATTGCA CAAGATAAAA ATATATCATC ATGAACAATA
 841 AAACTGTCTG CTTACATAAA CAGTAATACA AGGGGTGTTA TGAGCCATAT TCAACGGGAA
 901 ACGTCGAGGC CGCGATTAAA TTCCAACATG GATGCTGATT TATATGGGTA TAAATGGGCT
 961 CGCGATAATG TCGGGCAATC AGGTGCGACA ATCTATCGCT TGTATGGGAA GCCCGATGCG
1021 CCAGAGTTGT TTCTGAAACA TGGCAAAGGT AGCGTTGCCA ATGATGTTAC AGATGAGATG
1081 GTCAGACTAA ACTGGCTGAC GGAATTTATG CCTCTTCCGA CCATCAAGCA TTTTATCCGT
1141 ACTCCTGGTG ATGCATGGTT ACTCACCACT GCGATCCCCG GAAAAACAGC ATTCCAGGTA
1201 TTAGAAGAAT ATCCTGATTC AGGTGAAAAT ATTGTTGATG CGCTGGCAGT GTTCCTGCGC
1261 CGGTTGCATT CGATTCCTGT TTGTAATTGT CCTTTTAACA GCGATCGCGT ATTTCGTCTC
1321 GCTCAGGCGC AATCACGAAT GAATAACGGT TTGGTTGATG CGAGTGATTT TGATGACGAG
1381 CGTAATGGCT GGCCTGTTGA ACAAGTCTGG AAAGAAATGC ATAAACTTTT GCCATTCTCA
1441 CCGGATTCAG TCGTCACTCA TGGTGATTTC TCACTTGATA ACCTTATTTT TGACGAGGGG
1501 AAATTAATAG GTTGTATTGA TGTTGGACGA GTCGGAATCG CAGACCGATA CCAGGATCTT
1561 GCCATCCTAT GGAACTGCCT CGGTGAGTTT TCTCCTTCAT TACAGAAACG GCTTTTTCAA
1621 AAATATGGTA TTGATAATCC TGATATGAAT AAATTGCAGT TTCATTTGAT GCTCGATGAG
1681 TTTTTCTAAT CAGAATTGGT TAATTGGTTG TAACATTATT CAGATTGGGC CCCGTTCCAC
1741 TGAGCGTCAG ACCCCGTAGA AAAGATCAAA GGATCTTCTT GAGATCCTTT TTTTCTGCGC
1801 GTAATCTGCT GCTTGCAAAC AAAAAAACCA CCGCTACCAG CGGTGGTTTG TTTGCCGGAT
1861 CAAGAGCTAC CAACTCTTTT TCCGAAGGTA ACTGGCTTCA GCAGAGCGCA GATACCAAAT
1921 ACTGTTCTTC TAGTGTAGCC GTAGTTAGGC CACCACTTCA AGAACTCTGT AGCACCGCCT
1981 ACATACCTCG CTCTGCTAAT CCTGTTACCA GTGGCTGCTG CCAGTGGCGA TAAGTCGTGT
2041 CTTACCGGGT TGGACTCAAG ACGATAGTTA CCGGATAAGG CGCAGCGGTC GGGCTGAACG
2101 GGGGGTTCGT GCACACAGCC CAGCTTGGAG CGAACGACCT ACACCGAACT GAGATACCTA
2161 CAGCGTGAGC TATGAGAAAG CGCCACGCTT CCCGAAGGGA GAAAGGCGGA CAGGTATCCG
2221 GTAAGCGGCA GGGTCGGAAC AGGAGAGCGC ACGAGGGAGC TTCCAGGGGG AAACGCCTGG
2281 TATCTTTATA GTCCTGTCGG GTTTCGCCAC CTCTGACTTG AGCGTCGATT TTTGTGATGC
2341 TCGTCAGGGG GGCGGAGCCT ATGGAAAAAC GCCAGCAACG CGGCCTTTTT ACGGTTCCTG
2401 GCCTTTTGCT GGCCTTTTGC TCACATGTTC TTTCCTGCGT TATCCCCTGA TTCTGTGGAT
2461 AACCGTATTA CCGCTAGCAT GGATCTCGGG GACGTCTAAC TACTAAGCGA GAGTAGGGAA
2521 CTGCCAGGCA TCAAATAAAA CGAAAGGCTC AGTCGGAAGA CTGGGCCTTT CGTTTTATCT
2581 GTTGTTTGTC GGTGAACGCT CTCCTGAGTA GGACAAATCC GCCGGGAGCG ATTTGAACG
2641 TTGTGAAGCA ACGGCCCGGA GGGTGGCGGG CAGGACGCCC GCCATAAACT GCCAGGCATC
2701 AAACTAAGCA GAAGGCCATC
```

FIG.13B

Cloning sites of the Entry Vector pENTR5

```
      Int         attL1                    NdeI      XmnI     SalI
     ttg tac aaa aaa gca ggc ttt cat atg gga acc aat tca gtc
     aac atg ttt ttt cgt ccg aaa gta tac cct tgg tta agt cag
     Leu Tyr Lys Lys Ala Gly Phe His Met Gly Thr Asn Ser Val
```

```
          BamHI        KpnI    EcoRI                        EcoRI
         gac tgg atc cgg tac cga att cgc --- Death --- aga att cgc
         ctg acc tag gcc atg gct taa gcg --- (ccdB) --- tct taa gcg
         Asp Trp Ile Arg Tyr Arg Ile
```

```
     NotI    XhoI    EcoRV    Xba              Int attL2
    ggc cgc act cga gat atc tag acc cag ctt tct tgt aca aag ---
    ccg gcg tga gct cta tag atc tgg gtc gaa aga aca tgt ttc ---
```

FIG.14A pENTR5 2720 bp

| Location (Base Nos.) | Gene Encoded |
|---|---|
| 67..166 | attL1 |
| 324..629 | ccdB |
| 658..757 | attL2 |
| 880..1689 | KmR |
| 1794..2367 | ori |

```
   1 CTGACGGATG GCCTTTTTGC GTTTCTACAA ACTCTTCCTG TTAGTTAGTT ACTTAAGCTC
  61 GGGCCCCAAA TAATGATTTT ATTTTGACTG ATAGTGACCT GTTCGTTGCA ACAAATTGAT
 121 AAGCAATGCT TTTTTATAAT GCCAACTTTG TACAAAAAAG CAGGCTTTCA TATGGGAACC
 181 AATTCAGTCG ACTGGATCCG GTACCGAATT CGCTTACTAA AAGCCAGATA ACAGTATGCG
 241 TATTTGCGCG CTGATTTTTG CGGTATAAGA ATATATACTG ATATGTATAC CCGAAGTATG
 301 TCAAAAAGAG GTGTGCTTCT AGAATGCAGT TTAAGGTTTA CACCTATAAA AGAGAGAGCC
 361 GTTATCGTCT GTTTGTGGAT GTACAGAGTG ATATTATTGA CACGCCCGGG CGACGGATGG
 421 TGATCCCCCT GGCCAGTGCA CGTCTGCTGT CAGATAAAGT CTCCCGTGAA CTTTACCCGG
 481 TGGTGCATAT CGGGGATGAA AGCTGGCGCA TGATGACCAC CGATATGGCC AGTGTGCCGG
 541 TCTCCGTTAT CGGGGAAGAA GTGGCTGATC TCAGCCACCG CGAAAATGAC ATCAAAAACG
 601 CCATTAACCT GATGTTCTGG GGAATATAGA ATTCGCGGCC GCACTCGAGA TATCTAGACC
 661 CAGCTTTCTT GTACAAAGTT GGCATTATAA GAAAGCATTG CTTATCAATT TGTTGCAACG
 721 AACAGGTCAC TATCAGTCAA AATAAAATCA TTATTTGCCA TCCAGCTGCA GCTCTGGCCC
 781 GTGTCTCAAA ATCTCTGATG TTACATTGCA CAAGATAAAA ATATATCATC ATGAACAATA
 841 AAACTGTCTG CTTACATAAA CAGTAATACA AGGGGTGTTA TGAGCCATAT TCAACGGGAA
 901 ACGTCGAGGC CGCGATTAAA TTCCAACATG GATGCTGATT TATATGGGTA TAAATGGGCT
 961 CGCGATAATG TCGGGCAATC AGGTGCGACA ATCTATCGCT TGTATGGGAA GCCCGATGCG
1021 CCAGAGTTGT TTCTGAAACA TGGCAAAGGT AGCGTTGCCA ATGATGTTAC AGATGAGATG
1081 GTCAGACTAA ACTGGCTGAC GGAATTTATG CCTCTTCCGA CCATCAAGCA TTTTATCCGT
1141 ACTCCTGATG ATGCATGGTT ACTCACCACT GCGATCCCCG GAAAAACAGC ATTCCAGGTA
1201 TTAGAAGAAT ATCCTGATTC AGGTGAAAAT ATTGTTGATG CGCTGGCAGT GTTCCTGCGC
1261 CGGTTGCATT CGATTCCTGT TTGTAATTGT CCTTTTAACA GCGATCGCGT ATTTCGTCTC
1321 GCTCAGGCGC AATCACGAAT GAATAACGGT TTGGTTGATG CGAGTGATTT TGATGACGAG
1381 CGTAATGGCT GGCCTGTTGA ACAAGTCTGG AAAGAAATGC ATAAACTTTT GCCATTCTCA
1441 CCGGATTCAG TCGTCACTCA TGGTGATTTC TCACTTGATA ACCTTATTTT TGACGAGGGG
1501 AAATTAATAG GTTGTATTGA TGTTGGACGA GTCGGAATCG CAGACCGATA CCAGGATCTT
1561 GCCATCCTAT GGAACTGCCT CGGTGAGTTT TCTCCTTCAT TACAGAAACG GCTTTTTCAA
1621 AAATATGGTA TTGATAATCC TGATATGAAT AAATTGCAGT TTCATTTGAT GCTCGATGAG
1681 TTTTTCTAAT CAGAATTGGT TAATTGGTTG TAACATTATT CAGATTGGGC CCCGTTCCAC
1741 TGAGCGTCAG ACCCCGTAGA AAAGATCAAA GGATCTTCTT GAGATCCTTT TTTTCTGCGC
1801 GTAATCTGCT GCTTGCAAAC AAAAAAACCA CCGCTACCAG CGGTGGTTTG TTTGCCGGAT
1861 CAAGAGCTAC CAACTCTTTT TCCGAAGGTA ACTGGCTTCA GCAGAGCGCA GATACCAAAT
1921 ACTGTTCTTC TAGTGTAGCC GTAGTTAGGC CACCACTTCA AGAACTCTGT AGCACCGCCT
1981 ACATACCTCG CTCTGCTAAT CCTGTTACCA GTGGCTGCTG CCAGTGGCGA TAAGTCGTGT
2041 CTTACCGGGT TGGACTCAAG ACGATAGTTA CCGGATAAGG CGCAGCGGTC GGGCTGAACG
2101 GGGGGTTCGT GCACACAGCC CAGCTTGGAG CGAACGACCT ACACCGAACT GAGATACCTA
2161 CAGCGTGAGC TATGAGAAAG CGCCACGCTT CCCGAAGGGA GAAAGGCGGA CAGGTATCCG
2221 GTAAGCGGCA GGGTCGGAAC AGGAGAGCGC ACGAGGGAGC TTCCAGGGGG AAACGCCTGG
2281 TATCTTTATA GTCCTGTCGG GTTTCGCCAC CTCTGACTTG AGCGTCGATT TTTGTGATGC
2341 TCGTCAGGGG GGCGGAGCCT ATGGAAAAAC GCCAGCAACG CGGCCTTTTT ACGGTTCCTG
2401 GCCTTTTGCT GGCCTTTTGC TCACATGTTC TTTCCTGCGT TATCCCCTGA TTCTGTGGAT
2461 AACCGTATTA CCGCTAGCAT GGATCTCGGG GACGTCTAAC TACTAAGCGA GAGTAGGGAA
2521 CTGCCAGGCA TCAATAAAAA CGAAAGGCTC AGTCGGAAGA CTGGGCCTTT CGTTTTATCT
2581 GTTGTTTGTC GGTGAACGCT CTCCTGAGTA GGACAAATCC GCCGGGAGCG GATTTGAACG
2641 TTGTGAAGCA ACGGCCCGGA GGGTGGCGGG CAGGACGCCC GCCATAAACT GCCAGGCATC
2701 AAACTAAGCA GAAGGCCATC
```

FIG.14B

Cloning sites of the Entry Vector pENTR6

```
   Int      attL1                      SphI        XmnI      SalI
//tg tac aaa aaa gca ggc tgc atg cga acc aat tca gtc
//ac atg ttt ttt cgt ccg acg tac gct tgg tta agt cag
         Leu Tyr Lys Lys Ala Gly Cys Met Arg Thr Asn Ser Val
```

```
   BamHI      KpnI EcoRI                         EcoRI
gac tgg atc cgg tac cga att cgc --- Death --- aga att cgc
ctg acc tag gcc atg gct taa gcg --- (ccdB) --- tct taa gcg
  Asp Trp Ile Arg Tyr Arg Ile
```

```
Not   XhoI  EcoRV XbaI                    Int     attL2
ggc cgc act cga gat atc tag acc cag ctt tct tgt aca aag//
ccg gcg tga gct cta tag atc tgg gtc gaa aga aca tgt ttc//
```

FIG. 15A pENTR6 2717 bp

| Location (Base Nos.) | Gene Encoded |
|---|---|
| 67..166 | attL1 |
| 321..626 | ccdB |
| 655..754 | attL2 |
| 877..1686 | KmR |
| 1791..2364 | ori |

```
   1 CTGACGGATG GCCTTTTTGC GTTTCTACAA ACTCTTCCTG TTAGTTAGTT ACTTAAGCTC
  61 GGGCCCCAAA TAATGATTTT ATTTTGACTG ATAGTGACCT GTTCGTTGCA ACAAATTGAT
 121 AAGCAATGCT TTTTTATAAT GCCAACTTTG TACAAAAAAG CAGGCTGCAT GCGAACCAAT
 181 TCAGTCGACT GGATCCGGTA CCGAATTCGC TTACTAAAAG CCAGATAACA GTATGCGTAT
 241 TTGCGCGCTG ATTTTTGCGG TATAAGAATA TATACTGATA TGTATACCCG AAGTATGTCA
 301 AAAAGAGGTG TGCTTCTAGA ATGCAGTTTA AGGTTTACAC CTATAAAAGA GAGAGCCGTT
 361 ATCGTCTGTT TGTGGATGTA CAGAGTGATA TTATTGACAC GCCCGGGCGA CGGATGGTGA
 421 TCCCCCTGGC CAGTGCACGT CTGCTGTCAG ATAAAGTCTC CCGTGAACTT TACCCGGTGG
 481 TGCATATCGG GGATGAAAGC TGGCGCATGA TGACCACCGA TATGGCCAGT GTGCCGGTCT
 541 CCGTTATCGG GGAAGAAGTG GCTGATCTCA GCCACCGCGA AAATGACATC AAAAACGCCA
 601 TTAACCTGAT GTTCTGGGGA ATATAGAATT CGCGGCCGCA CTCGAGATAT CTAGACCCAG
 661 CTTTCTTGTA CAAAGTTGGC ATTATAAGAA AGCATTGCTT ATCAATTTGT TGCAACGAAC
 721 AGGTCACTAT CAGTCAAAAT AAAATCATTA TTTGCCATCC AGCTGCAGCT CTGGCCCGTG
 781 TCTCAAAATC TCTGATGTTA CATTGCACAA GATAAAAATA TATCATCATG AACAATAAAA
 841 CTGTCTGCTT ACATAAACAG TAATACAAGG GGTGTTATGA GCCATATTCA ACGGGAAACG
 901 TCGAGGCCGC GATTAAATTC CAACATGGAT GCTGATTTAT ATGGGTATAA ATGGGCTCGC
 961 GATAATGTCG GGCAATCAGG TGCGACAATC TATCGCTTGT ATGGGAAGCC CGATGCGCCA
1021 GAGTTGTTTC TGAAACATGG CAAAGGTAGC GTTGCCAATG ATGTTACAGA TGAGATGGTC
1081 AGACTAAACT GGCTGACGGA ATTTATGCCT CTTCCGACCA TCAAGCATTT TATCCGTACT
1141 CCTGATGATG CATGGTTACT CACCACTGCG ATCCCCGGAA AAACAGCATT CCAGGTATTA
1201 GAAGAATATC CTGATTCAGG TGAAAATATT GTTGATGCGC TGGCAGTGTT CCTGCGCCGG
1261 TTGCATTCGA TTCCTGTTTG TAATTGTCCT TTTAACAGCG ATCGCGTATT TCGTCTCGCT
1321 CAGGCGCAAT CACGAATGAA TAACGGTTTG GTTGATGCGA GTGATTTTGA TGACGAGCGT
1381 AATGGCTGGC CTGTTGAACA AGTCTGGAAA GAAATGCATA AACTTTTGCC ATTCTCACCG
1441 GATTCAGTCG TCACTCATGG TGATTTCTCA CTTGATAACC TTATTTTTGA CGAGGGGAAA
1501 TTAATAGGTT GTATTGATGT TGGACGAGTC GGAATCGCAG ACCGATACCA GGATCTTGCC
1561 ATCCTATGGA ACTGCCTCGG TGAGTTTTCT CCTTCATTAC AGAAACGGCT TTTTCAAAAA
1621 TATGGTATTG ATAATCCTGA TATGAATAAA TTGCAGTTTC ATTTGATGCT CGATGAGTTT
1681 TTCTAATCAG AATTGGTTAA TTGGTTGTAA CATTATTCAG ATTGGGCCCC GTTCCACTGA
1741 GCGTCAGACC CCGTAGAAAA GATCAAAGGA TCTTCTTGAG ATCCTTTTTT TCTGCGCGTA
1801 ATCTGCTGCT TGCAAACAAA AAAACCACCG CTACCAGCGG TGGTTTGTTT GCCGGATCAA
1861 GAGCTACCAA CTCTTTTTCC GAAGGTAACT GGCTTCAGCA GAGCGCAGAT ACCAAATACT
1921 GTTCTTCTAG TGTAGCCGTA GTTAGGCCAC CACTTCAAGA ACTCTGTAGC ACCGCCTACA
1981 TACCTCGCTC TGCTAATCCT GTTACCAGTG GCTGCTGCCA GTGGCGATAA GTCGTGTCTT
2041 ACCGGGTTGG ACTCAAGACG ATAGTTACCG GATAAGGCGC AGCGGTCGGG CTGAACGGGG
2101 GGTTCGTGCA CACAGCCCAG CTTGGAGCGA ACGACCTACA CCGAACTGAG ATACCTACAG
2161 CGTGAGCTAT GAGAAAGCGC CACGCTTCCC GAAGGGAGAA AGGCGGACAG GTATCCGGTA
2221 AGCGGCAGGG TCGGAACAGG AGAGCGCACG AGGGAGCTTC CAGGGGGAAA CGCCTGGTAT
2281 CTTTATAGTC CTGTCGGGTT TCGCCACCTC TGACTTGAGC GTCGATTTTT GTGATGCTCG
2341 TCAGGGGGGC GGAGCCTATG GAAAAACGCC AGCAACGCGG CCTTTTTACG GTTCCTGGCC
2401 TTTTGCTGGC CTTTTGCTCA CATGTTCTTT CCTGCGTTAT CCCCTGATTC TGTGGATAAC
2461 CGTATTACCG CTAGCATGGA TCTCGGGGAC GTCTAACTAC TAAGCGAGAG TAGGGAACTG
2521 CCAGGCATCA AATAAAACGA AAGGCTCAGT CGGAAGACTG GGCCTTTCGT TTTATCTGTT
2581 GTTTGTCGGT GAACGCTCTC CTGAGTAGGA CAAATCCGCC GGGAGCGGAT TTGAACGTTG
2641 TGAAGCAACG GCCCGGAGGG TGGCGGGCAG GACGCCCGCC ATAAACTGCC AGGCATCAAA
2701 CTAAGCAGAA GGCCATC
```

FIG.15B

Cloning sites of the Entry Vector pENTR7

```
         attL1
----ttg tac aaa aaa gca ggc ttt gaa aac ctg tat ttt caa gga
----aac atg ttt ttt cgt ccg aaa ctt ttg gac ata aaa gtt cct Leu Tyr Lys Lys Ala Gly Phe Glu Asn Leu Tyr Phe Gln Gly
                                                        ↑
                                                  TEV Protease XmnI          SalI         BamHI      KpnI  EcoRI
acc|gtt tca tgc atc g|tc gac t|gg atc cgg tac|cga att cgc---
tgg|caa agt acg tag cag ct|g acc tag|gcc atg gct taa|gcg---

Thr Val Ser Cys Ile Val Asp Trp Ile Arg Tyr Arg Ile

EcoRI      NotI      XhoI   EcoRV   XbaI
-[Death]----aga att cgc|ggc cgc ac|t cga gat|atc tag|acc cag
-[(ccdB)]---tct taa|gcg ccg gcg tga gct|cta tag atc|tgg gtc Int
         |   att L2
         ctt tct tgt aca aag---
         gaa aga aca tgt ttc---
```

FIG.16A pENTR7 2738 bp

| Location (Base Nos.) | Gene Encoded |
|---|---|
| 67..166 | attL1 |
| 342..647 | ccdB |
| 676..775 | attL2 |
| 898..1707 | KmR |
| 1812..2385 | ori |

```
   1 CTGACGGATG GCCTTTTTGC GTTTCTACAA ACTCTTCCTG TTAGTTAGTT ACTTAAGCTC
  61 GGGCCCCAAA TAATGATTTT ATTTTGACTG ATAGTGACCT GTTCGTTGCA ACAAATTGAT
 121 AAGCAATGCT TTTTTATAAT GCCAACTTTG TACAAAAAAG CAGGCTTTGA AAACCTGTAT
 181 TTTCAAGGAA CCGTTTCATG CATCGTCGAC TGGATCCGGT ACCGAATTCG CTTACTAAAA
 241 GCCAGATAAC AGTATGCGTA TTTGCGCGCT GATTTTTGCG GTATAAGAAT ATATACTGAT
 301 ATGTATACCC GAAGTATGTC AAAAAGAGGT GTGCTTCTAG AATGCAGTTT AAGGTTTACA
 361 CCTATAAAAG AGAGAGCCGT TATCGTCTGT TTGTGGATGT ACAGAGTGAT ATTATTGACA
 421 CGCCCGGGCG ACGGATAGTG ATCCCCCTGG CCAGTGCACG TCTGCTGTCA GATAAAGTCT
 481 CCCGTGAACT TTACCCGGTG GTGCATATCG GGGATGAAAG CTGGCGCATG ATGACCACCG
 541 ATATGGCCAG TGTGCCGGTC TCCGTTATCG GGGAAGAAGT GGCTGATCTC AGCCACCGCG
 601 AAAATGACAT CAAAAACGCC ATTAACCTGA TGTTCTGGGG AATATAGAAT TCGCGGCCGC
 661 ACTCGAGATA TCTAGACCCA GCTTTCTTGT ACAAAGTTGG CATTATAAGA AAGCATTGCT
 721 TATCAATTTG TTGCAACGAA CAGGTCACTA TCAGTCAAAA TAAAATCATT ATTTGCCATC
 781 CAGCTGCAGC TCTGGCCCGT GTCTCAAAAT CTCTGATGTT ACATTGCACA AGATAAAAAT
 841 ATATCATCAT GAACAATAAA ACTGTCTGCT TACATAAACA GTAATACAAG GGGTGTTATG
 901 AGCCATATTC AACGGGAAAC GTCGAGGCCG CGATTAAATT CCAACATGGA TGCTGATTTA
 961 TATGGGTATA AATGGGCTCG CGATAATGTC GGGCAATCAG GTGCGACAAT CTATCGCTTG
1021 TATGGGAAGC CCGATGCGCC AGAGTTGTTT CTGAAACATG GCAAAGGTAG CGTTGCCAAT
1081 GATGTTACAG ATGAGATGGT CAGACTAAAC TGGCTGACGG AATTTATGCC TCTTCCGACC
1141 ATCAAGCATT TTATCCGTAC TCCTGATGAT GCATGGTTAC TCACCACTGC GATCCCCGGA
1201 AAAACAGCAT TCCAGGTATT AGAAGAATAT CCTGATTCAG GTGAAAATAT TGTTGATGCG
1261 CTGGCAGTGT TCCTGCGCCG GTTGCATTCG ATTCCTGTTT GTAATTGTCC TTTTAACAGC
1321 GATCGCGTAT TTCGTCTCGC TCAGGCGCAA TCACGAATGA ATAACGGTTT GGTTGATGCG
1381 AGTGATTTTG ATGACGAGCG TAATGGCTGG CCTGTTGAAC AAGTCTGGAA AGAAATGCAT
1441 AAACTTTTGC CATTCTCACC GGATTCAGTC GTCACTCATG GTGATTTCTC ACTTGATAAC
1501 CTTATTTTTG ACGAGGGGAA ATTAATAGGT TGTATTGATG TTGGACGAGT CGGAATCGCA
1561 GACCGATACC AGGATCTTGC CATCCTATGG AACTGCCTCG GTGAGTTTTC TCCTTCATTA
1621 CAGAAACGGC TTTTTCAAAA ATATGGTATT GATAATCCTG ATATGAATAA ATTGCAGTTT
1681 CATTTGATGC TCGATGAGTT TTTCTAATCA GAATTGGTTA ATTGGTTGTA ACATTATTCA
1741 GATTGGGCCC CGTTCCACTG AGCGTCAGAC CCCGTAGAAA AGATCAAAGG ATCTTCTTGA
1801 GATCCTTTTT TTCTGCGCGT AATCTGCTGC TTGCAAACAA AAAAACCACC GCTACCAGCG
1861 GTGGTTTGTT TGCCGGATCA AGAGCTACCA ACTCTTTTTC CGAAGGTAAC TGGCTTCAGC
1921 AGAGCGCAGA TACCAAATAC TGTTCTTCTA GTGTAGCCGT AGTTAGGCCA CCACTTCAAG
1981 AACTCTGTAG CACCGCCTAC ATACCTCGCT CTGCTAATCC TGTTACCAGT GGCTGCTGCC
2041 AGTGGCGATA AGTCGTGTCT TACCGGGTTG GACTCAAGAC GATAGTTACC GGATAAGGCG
2101 CAGCGGTCGG GCTGAACGGG GGGTTCGTGC ACACAGCCCA GCTTGGAGCG AACGACCTAC
2161 ACCGAACTGA GATACCTACA GCGTGAGCTA TGAGAAAGCG CCACGCTTCC CGAAGGGAGA
2221 AAGGCGGACA GGTATCCGGT AAGCGGCAGG GTCGGAACAG GAGAGCGCAC GAGGGAGCTT
2281 CCAGGGGGAA ACGCCTGGTA TCTTTATAGT CCTGTCGGGT TTCGCCACCT CTGACTTGAG
2341 CGTCGATTTT TGTGATGCTC GTCAGGGGGG CGGAGCCTAT GGAAAAACGC CAGCAACGCG
2401 GCCTTTTTAC GGTTCCTGGC CTTTTGCTGG CCTTTTGCTC ACATGTTCTT TCCTGCGTTA
2461 TCCCCTGATT CTGTGGATAA CCGTATTACC GCTAGCATGG ATCTCGGGGA CGTCTAACTA
2521 CTAAGCGAGA GTAGGGAACT GCCAGGCATC AAATAAAACG AAAGGCTCAG TCGGAAGACT
2581 GGGCCTTTCG TTTTATCTGT TGTTTGTCGG TGAACGCTCT CCTGAGTAGG ACAAATCCGC
2641 CGGGAGCGGA TTTGAACGTT GTGAAGCAAC GGCCCGGAGG GTGGCGGGCA GGACGCCCGC
2701 CATAAACTGC CAGGCATCAA ACTAAGCAGA AGGCCATC
```

FIG.16B

CLONING SITES OF THE ENTRY VECTOR pENTR8 pENTR8 2735 bp

| Location (Base Nos.) | Gene Encoded |
|---|---|
| 67..166 | attL1 |
| 339..644 | ccdB |
| 673..772 | attL2 |
| 895..1704 | KmR |
| 1809..2382 | ori |

```
   1 CTGACGGATG GCCTTTTTGC GTTTCTACAA ACTCTTCCTGTTAGTTAGTT ACTTAAGCTC
  61 GGGCCCCAAA TAATGATTTT ATTTTGACTG ATAGTGACCT GTTCGTTGCA ACAAATTGAT
 121 AAGCAATGCT TTTTTATAAT GCCAACTTTG TACAAAAAAG CAGGCTTTGA AAACCTGTAT
 181 TTTCAAGGAA CCATGGACCT AGTCGACTGG ATCCGGTACC GAATTCGCTT ACTAAAAGCC
 241 AGATAACAGT ATGCGTATTT GCGCGCTGAT TTTTGCGGTA TAAGAATATA TACTGATATG
 301 TATACCCGAA GTATGTCAAA AAGAGGTGTG CTTCTAGAAT GCAGTTTAAG GTTTACACCT
 361 ATAAAAGAGA GAGCCGTTAT CGTCTGTTTG TGGATGTACA GAGTGATATT ATTGACACGC
 421 CCGGGCGACG GATAGTGATC CCCCTGGCCA GTGCACGTCT GCTGTCAGAT AAAGTCTCCC
 481 GTGAACTTTA CCCGGTGGTG CATATCGGGG ATGAAAGCTG GCGCATGATG ACCACCGATA
 541 TGGCCAGTGT GCCGGTCTCC GTTATCGGGG AAGAAGTGGC TGATCTCAGC CACCGCGAAA
 601 ATGACATCAA AAACGCCATT AACCTGATGT TCTGGGGAAT ATAGAATTCG CGGCCGCACT
 661 CGAGATATCT AGACCCAGCT TTCTTGTACA AAGTTGGCAT TATAAGAAAG CATTGCTTAT
 721 CAATTTGTTG CAACGAACAG GTCACTATCA GTCAAAATAA AATCATTATT TGCCATCCAG
 781 CTGCAGCTCT GGCCCGTGTC TCAAAATCTC TGATGTTACA TTGCACAAGA TAAAAATATA
 841 TCATCATGAA CAATAAAACT GTCTGCTTAC ATAAACAGTA ATACAAGGGG TGTTATGAGC
 901 CATATTCAAC GGGAAACGTC GAGGCCGCGA TTAAATTCCA ACATGGATGC TGATTTATAT
 961 GGGTATAAAT GGGCTCGCGA TAATGTCGGG CAATCAGGTG CGACAATCTA TCGCTTGTAT
1021 GGGAAGCCCG ATGCGCCAGA GTTGTTTCTG AAACATGGCA AAGGTAGCGT TGCCAATGAT
1081 GTTACAGATG AGATGGTCAG ACTAAACTGG CTGACGGAAT TTATGCCTCT TCCGACCATC
1141 AAGCATTTTA TCCGTACTCC TGATGATGCA TGGTTACTCA CCACTGCGAT CCCCGGAAAA
1201 ACAGCATTCC AGGTATTAGA AGAATATCCT GATTCAGGTG AAAATATTGT TGATGCGCTG
1261 GCAGTGTCCC TGCGCCGGTT GCATTCGATT CCTGTTTGTA ATTGTCCTTT TAACAGCGAT
1321 CGCGTATTTC GTCTCGCTCA GGCGCAATCA CGAATGAATA ACGGTTTGGT TGATGCGAGT
1381 GATTTTGATG ACGAGCGTAA TGGCTGGCCT GTTGAACAAG TCTGGAAAGA AATGCATAAA
1441 CTTTTGCCAT TCTCACCGGA TTCAGTCGTC ACTCATGGTG ATTTCTCACT TGATAACCTT
1501 ATTTTTGACG AGGGGAAATT AATAGGTTGT ATTGATGTTG GACGAGTCGG AATCGCAGAC
1561 CGATACCAGG ATCTTGCCAT CCTATGGAAC TGCCTCGGTG AGTTTTCTCC TTCATTACAG
1621 AAACGGCTTT TTCAAAAATA TGGTATTGAT AATCCTGATA TGAATAAATT GCAGTTTCAT
1681 TTGATGCTCG ATGAGTTTTT CTAATCAGAA TTGGTTAATT GGTTGTAACA TTATTCAGAT
1741 TGGGCCCCGT TCCACTGAGC GTCAGACCCC GTAGAAAAGA TCAAAGGATC TTCTTGAGAT
1801 CCTTTTTTTC TGCGCGTAAT CTGCTGCTTG CAAACAAAAA AACCACCGCT ACCAGCGGTG
1861 GTTTGTTTGC CGGATCAAGA GCTACCAACT CTTTTTCCGA AGGTAACTGG CTTCAGCAGA
1921 GCGCAGATAC CAAATACTGT TCTTCTAGTG TAGCCGTAGT TAGGCCACCA CTTCAAGAAC
1981 TCTGTAGCAC CGCCTACATA CCTCGCTCTG CTAATCCTGT TACCAGTGGC TGCTGCCAGT
2041 GGCGATAAGT CGTGTCTTAC CGGGTTGGAC TCAAGACGAT AGTTACCGGA TAAGGCGCAG
2101 CGGTCGGGCT GAACGGGGGG TTCGTGCACA CAGCCCAGCT TGGAGCGAAC GACCTACACC
2161 GAACTGAGAT ACCTACAGCG TGAGCTATGA GAAAGCGCCA CGCTTCCCGA AGGGAGAAAG
2221 GCGGACAGGT ATCCGGTAAG CGGCAGGGTC GGAACAGGAG AGCGCACGAG GGAGCTTCCA
2281 GGGGGAAACG CCTGGTATCT TTATAGTCCT GTCGGGTTTC GCCACCTCTG ACTTGAGCGT
2341 CGATTTTTGT GATGCTCGTC AGGGGGGCGG AGCCTATGGA AAAACGCCAG CAACGCGGCC
2401 TTTTTACGGT TCCTGGCCTT TTGCTGGCCT TTTGCTCACA TGTTCTTTCC TGCGTTATCC
2461 CCTGATTCTG TGGATAACCG TATTACCGCT AGCATGGATC TCGGGACGT CTAACTACTA
2521 AGCGAGAGTA GGGAACTGCC AGGCATCAAA TAAAACGAAA GGCTCAGTCG AAGACTGGG
2581 CCTTTCGTTT TATCTGTTGT TTGTCGGTGA ACGCTCTCCT GAGTAGGACA AATCCGCCGG
2641 GAGCGGATTT GAACGTTGTG AAGCAACGGC CCGGAGGGTG GCGGGCAGGA CGCCCGCCAT
2701 AAACTGCCAG GCATCAAACT AAGCAGAAGG CCATC
```

FIG.17B

CLONING SITES OF THE ENTRY VECTOR pENTR9

Int     attL1
ttg tac aaa aaa gca ggc ttt | gaa aac ctg tat ttt caa gga
aac atg ttt ttt cgt ccg aaa | ctt ttg gac ata aaa gtt cct Leu Tyr Lys Lys Ala Gly Phe Glu Asn Leu Tyr Phe Gln Gly TEV Protease Nde I   BglII   SalI    BamHI       KpnI   EcoRI
ca|t atg |aga tct g|tc gac tg|g atc cgg tac|cga att cgc---
gta t|ac tct aga| cag ctg| acc tag|gc atg gct taa|gcg---

His Met Arg Ser Val Asp Trp Ile Arg Tyr Arg Ile

EcoRI   NotI    XhoI    EcoRV  XbaI    attL2
Death ---ag|a att cgc|ggc cgc ac|t cga gat |atc tag |acc cag
      ---tct taa|gcg ccg gcg tga gct| cta|tag atc|tgg gtc Int
ctt tct tgt aca aag---
gaa aga aca tgt ttc

FIG.18A pENTR9 2735 bp

| Location (Base Nos.) | Gene Encoded |
|---|---|
| 67..166 | attL1 |
| 339..644 | ccdB |
| 673..772 | attL2 |
| 895..1704 | KmR |
| 1809..2382 | ori |

```
   1 CTGACGGATG GCCTTTTTGC GTTTCTACAA ACTCTTCCTG TTAGTTAGTT ACTTAAGCTC
  61 GGGCCCCAAA TAATGATTTT ATTTTGACTG ATAGTGACCT GTTCGTTGCA ACAAATTGAT
 121 AAGCAATGCT TTTTTATAAT GCCAACTTTG TACAAAAAAG CAGGCTTTGA AAACCTGTAT
 181 TTTCAAGGAC ATATGAGATC TGTCGACTGG ATCCGGTACC GAATTCGCTT ACTAAAAGCC
 241 AGATAACAGT ATGCGTATTT GCGCGCTGAT TTTTGCGGTA TAAGAATATA TACTGATATG
 301 TATACCCGAA GTATGTCAAA AAGAGGTGTG CTTCTAGAAT GCAGTTTAAG GTTTACACCT
 361 ATAAAAGAGA GAGCCGTTAT CGTCTGTTTG TGGATGTACA GAGTGATATT ATTGACACGC
 421 CCGGGCGACG GATAGTGATC CCCCTGGCCA GTGCACGTCT GCTGTCAGAT AAAGTCTCCC
 481 GTGAACTTTA CCCGGTGGTG CATATCGGGG ATGAAAGCTG GCGCATGATG ACCACCGATA
 541 TGGCCAGTGT GCCGGTCTCC GTTATCGGGG AAGAAGTGGC TGATCTCAGC CACCGCGAAA
 601 ATGACATCAA AAACGCCATT AACCTGATGT TCTGGGGAAT ATAGAATTCG CGGCCGCACT
 661 CGAGATATCT AGACCCAGCT TTCTTGTACA AAGTTGGCAT TATAAGAAAG CATTGCTTAT
 721 CAATTTGTTG CAACGAACAG GTCACTATCA GTCAAAATAA AATCATTATT TGCCATCCAG
 781 CTGCAGCTCT GGCCCGTGTC TCAAAATCTC TGATGTTACA TTGCACAAGA TAAAAATATA
 841 TCATCATGAA CAATAAAACT GTCTGCTTAC ATAAACAGTA ATACAAGGGG TGTTATGAGC
 901 CATATTCAAC GGGAAACGTC GAGGCCGCGA TTAAATTCCA ACATGGATGC TGATTTATAT
 961 GGGTATAAAT GGGCTCGCGA TAATGTCGGG CAATCAGGTG CGACAATCTA TCGCTTGTAT
1021 GGGAAGCCCG ATGCGCCAGA GTTGTTTCTG AAACATGGCA AAGGTAGCGT TGCCAATGAT
1081 GTTACAGATG AGATGGTCAG ACTAAACTGG CTGACGGAAT TTATGCCTCT TCCGACCATC
1141 AAGCATTTTA TCCGTACTCC TGATGATGCA TGGTTACTCA CCACTGCGAT CCCCGGAAAA
1201 ACAGCATTCC AGGTATTAGA AGAATATCCT GATTCAGGTG AAAATATTGT TGATGCGCTG
1261 GCAGTGTCCC TGCGCCGGTT GCATTCGATT CCTGTTTGTA ATTGTCCTTT TAACAGCGAT
1321 CGCGTATTTC GTCTCGCTCA GGCGCAATCA CGAATGAATA ACGGTTTGGT TGATGCGAGT
1381 GATTTTGATG ACGAGCGTAA TGGCTGGCCT GTTGAACAAG TCTGGAAAGA AATGCATAAA
1441 CTTTTGCCAT TCTCACCGGA TTCAGTCGTC ACTCATGGTG ATTTCTCACT TGATAACCTT
1501 ATTTTTGACG AGGGGAAATT AATAGGTTGT ATTGATGTTG GACGAGTCGG AATCGCAGAC
1561 CGATACCAGG ATCTTGCCAT CCTATGGAAC TGCCTCGGTG AGTTTTCTCC TTCATTACAG
1621 AAACGGCTTT TCAAAAATA TGGTATTGAT AATCCTGATA TGAATAAATT GCAGTTTCAT
1681 TTGATGCTCG ATGAGTTTTT CTAATCAGAA TTGGTTAATT GGTTGTAACA TTATTCAGAT
1741 TGGGCCCCGT TCCACTGAGC GTCAGACCCC GTAGAAAAGA TCAAAGGATC TTCTTGAGAT
1801 CCTTTTTTTC TGCGCGTAAT CTGCTGCTTG CAAACAAAAA AACCACCGCT ACCAGCGGTG
1861 GTTTGTTTGC CGGATCAAGA GCTACCAACT CTTTTTCCGA AGGTAACTGG CTTCAGCAGA
1921 GCGCAGATAC CAAATACTGT TCTTCTAGTG TAGCCGTAGT TAGGCCACCA CTTCAAGAAC
1981 TCTGTAGCAC CGCCTACATA CCTCGCTCTG CTAATCCTGT TACCAGTGGC TGCTGCCAGT
2041 GGCGATAAGT CGTGTCTTAC CGGGTTGGAC TCAAGACGAT AGTTACCGGA TAAGGCGCAG
2101 CGGTCGGGCT GAACGGGGGG TTCGTGCACA CAGCCCAGCT TGGAGCGAAC GACCTACACC
2161 GAACTGAGAT ACCTACAGCG TGAGCTATGA GAAAGCGCCA CGCTTCCCGA AGGGAGAAAG
2221 GCGGACAGGT ATCCGGTAAG CGGCAGGGTC GGAACAGGAG AGCGCACGAG GGAGCTTCCA
2281 GGGGGAAACG CCTGGTATCT TTATAGTCCT GTCGGGTTTC GCCACCTCTG ACTTGAGCGT
2341 CGATTTTTGT GATGCTCGTC AGGGGGGCGG AGCCTATGGA AAAACGCCAG CAACGCGGCC
2401 TTTTTACGGT TCCTGGCCTT TTGCTGGCCT TTTGCTCACA TGTTCTTTCC TGCGTTATCC
2461 CCTGATTCTG TGGATAACCG TATTACCGCT AGCATGGATC TCGGGGACGT CTAACTACTA
2521 AGCGAGAGTA GGGAACTGCC AGGCATCAAA TAAAACGAAA GGCTCAGTCG AAGACTGGG
2581 CCTTTCGTTT TATCTGTTGT TTGTCGGTGA ACGCTCTCCT GAGTAGGACA AATCCGCCGG
2641 GAGCGGATTT GAACGTTGTG AAGCAACGGC CCGGAGGGTG GCGGGCAGGA CGCCCGCCAT
2701 AAACTGCCAG GCATCAAACT AAGCAGAAGG CCATC
```

FIG.18B

CLONING SITES OF THE ENTRY VECTOR pENTR10
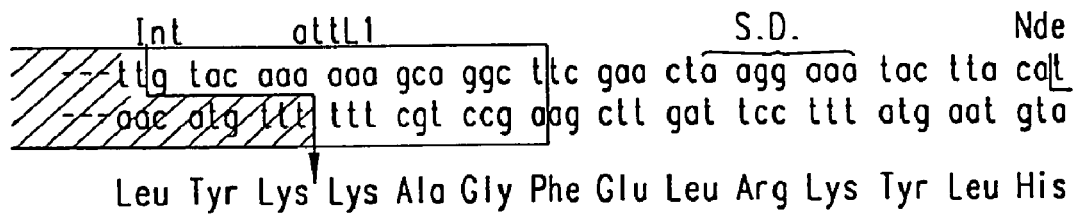
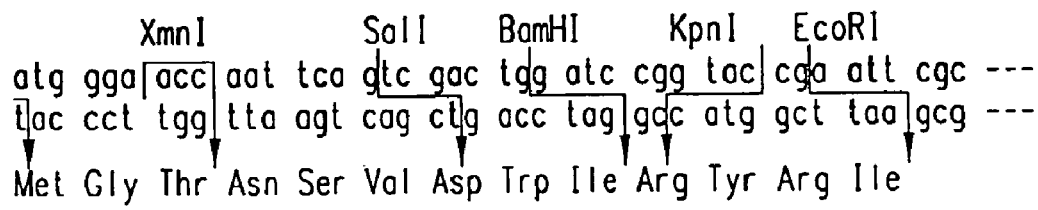
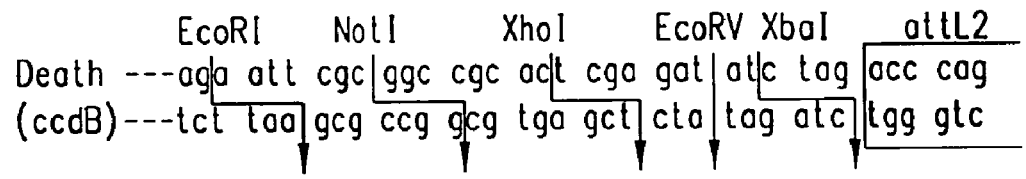
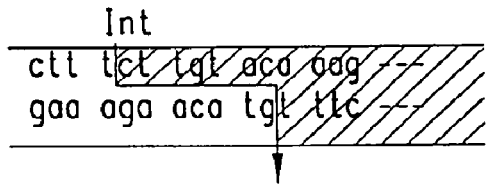
FIG.19A pENTR10 2738 bp

| Location (Base Nos.) | Gene Encoded |
|---|---|
| 67..166 | attL1 |
| 342..647 | ccdB |
| 676..775 | attL2 |
| 898..1707 | KmR |
| 1812..2385 | ori |

```
   1 CTGACGGATG GCCTTTTTGC GTTTCTACAA ACTCTTCCTG TTAGTTAGTT ACTTAAGCTC
  61 GGGCCCCAAA TAATGATTTT ATTTTGACTG ATAGTGACCT GTTCGTTGCA ACAAATTGAT
 121 AAGCAATGCT TTTTTATAAT GCCAACTTTG TACAAAAAAG CAGGCTTCGA ACTAAGGAAA
 181 TACTTACATA TGGGAACCAA TTCAGTCGAC TGGATCCGGT ACCGAATTCG CTTACTAAAA
 241 GCCAGATAAC AGTATGCGTA TTTGCGCGCT GATTTTTGCG GTATAAGAAT ATATACTGAT
 301 ATGTATACCC GAAGTATGTC AAAAAGAGGT GTGCTTCTAG AATGCAGTTT AAGGTTTACA
 361 CCTATAAAAG AGAGAGCCGT TATCGTCTGT TTGTGGATGT ACAGAGTGAT ATTATTGACA
 421 CGCCCGGGCG ACGGATGGTG ATCCCCCTGG CCAGTGCACG TCTGCTGTCA GATAAAGTCT
 481 CCCGTGAACT TTACCCGGTG GTGCATATCG GGGATGAAAG CTGGCGCATG ATGACCACCG
 541 ATATGGCCAG TGTGCCGGTC TCCGTTATCG GGGAAGAAGT GGCTGATCTC AGCCACCGCG
 601 AAAATGACAT CAAAAACGCC ATTAACCTGA TGTTCTGGGA AATATAGAAT TCGCGGCCGC
 661 ACTCGAGATA TCTAGACCCA GCTTTCTTGT ACAAAGTTGG CATTATAAGA AAGCATTGCT
 721 TATCAATTTG TTGCAACGAA CAGGTCACTA TCAGTCAAAA TAAAATCATT ATTTGCCATC
 781 CAGCTGCAGC TCTGGCCCGT GTCTCAAAAT CTCTGATGTT ACATTGCACA AGATAAAAAT
 841 ATATCATCAT GAACAATAAA ACTGTCTGCT TACATAAACA GTAATACAAG GGGTGTTATG
 901 AGCCATATTC AACGGGAAAC GTCGAGGCCG CGATTAAATT CCAACATGGA TGCTGATTTA
 961 TATGGGTATA AATGGGCTCG CGATAATGTC GGGCAATCAG GTGCGACAAT CTATCGCTTG
1021 TATGGGAAGC CCGATGCGCC AGAGTTGTTT CTGAAACATG GCAAAGGTAG CGTTGCCAAT
1081 GATGTTACAG ATGAGATGGT CAGACTAAAC TGGCTGACGG AATTTATGCC TCTTCCGACC
1141 ATCAAGCATT TTATCCGTAC TCCTGATGAT GCATGGTTAC TCACCACTGC GATCCCCGGA
1201 AAAACAGCAT TCCAGGTATT AGAAGAATAT CCTGATTCAG GTGAAAATAT TGTTGATGCG
1261 CTGGCAGTGT TCCTGCGCCG GTTGCATTCG ATTCCTGTTT GTAATTGTCC TTTTAACAGC
1321 GATCGCGTAT TTCGTCTCGC TCAGGCGCAA TCACGAATGA ATAACGGTTT GGTTGATGCG
1381 AGTGATTTTG ATGACGAGCG TAATGGCTGG CCTGTTGAAC AAGTCTGGAA AGAAATGCAT
1441 AAACTTTTGC CATTCTCACC GGATTCAGTC GTCACTCATG GTGATTTCTC ACTTGATAAC
1501 CTTATTTTTG ACGAGGGAA ATTAATAGGT TGTATTGATG TTGGACGAGT CGGAATCGCA
1561 GACCGATACC AGGATCTTGC CATCCTATGG AACTGCCTCG GTGAGTTTTC TCCTTCATTA
1621 CAGAAACGGC TTTTTCAAAA ATATGGTATT GATAATCCTG ATATGAATAA ATTGCAGTTT
1681 CATTTGATGC TCGATGAGTT TTTCTAATCA GAATTGGTTA ATTGGTTGTA ACATTATTCA
1741 GATTGGGCCC CGTTCCACTG AGCGTCAGAC CCCGTAGAAA AGATCAAAGG ATCTTCTTGA
1801 GATCCTTTTT TTCTGCGCGT AATCTGCTGC TTGCAAACAA AAAAACCACC GCTACCAGCG
1861 GTGGTTTGTT TGCCGGATCA GAGCTACCA ACTCTTTTTC CGAAGGTAAC TGGCTTCAGC
1921 AGAGCGCAGA TACCAAATAC TGTTCTTCTA GTGTAGCCGT AGTTAGGCCA CCACTTCAAG
1981 AACTCTGTAG CACCGCCTAC ATACCTCGCT CTGCTAATCC TGTTACCAGT GGCTGCTGCC
2041 AGTGGCGATA AGTCGTGTCT TACCGGGTTG GACTCAAGAC GATAGTTACC GGATAAGGCG
2101 CAGCGGTCGG GCTGAACGGG GGGTTCGTGC ACACAGCCCA GCTTGGAGCG AACGACCTAC
2161 ACCGAACTGA GATACCTACA GCGTGAGCTA TGAGAAAGCG CCACGCTTCC CGAAGGGAGA
2221 AAGGCGGACA GGTATCCGGT AAGCGGCAGG GTCGGAACAG GAGAGCGCAC GAGGGAGCTT
2281 CCAGGGGGAA ACGCCTGGTA TCTTTATAGT CCTGTCGGGT TTCGCCACCT CTGACTTGAG
2341 CGTCGATTTT TGTGATGCTC GTCAGGGGGG CGGAGCCTAT GGAAAAACGC CAGCAACGCG
2401 GCCTTTTTAC GGTTCCTGGC CTTTTGCTGG CCTTTTGCTC ACATGTTCTT TCCTGCGTTA
2461 TCCCCTGATT CTGTGGATAA CCGTATTACC GCTAGCATGG ATCTCGGGGA CGTCTAACTA
2521 CTAAGCGAGA GTAGGGAACT GCCAGGCATC AATAAAACG AAAGGCTCAG TCGGAAGACT
2581 GGGCCTTTCG TTTTATCTGT TGTTTGTCGG TGAACGCTCT CCTGAGTAGG ACAAATCCGC
2641 CGGGAGCGGA TTTGAACGTT GTGAAGCAAC GGCCCGGAGG GTGGCGGGCA GGACGCCCGC
2701 CATAAACTGC CAGGCATCAA ACTAAGCAGA AGGCCATC
```

FIG.19B

CLONING SITES OF THE ENTRY VECTOR pENTR11

Int    attL1                    S.D.    Kozak XmnI           S.D.
TTG TAC AAA AAA GCA GGC TTC GAA GGA GAT AGA ACC AAT TCT CTA AGG AAA TAC
AAC ATG TTT TTT CGT CCG AAG CTT CCT CTA TCT TGG TTA AGA GAT TCC TTT ATG Leu Tyr Lys Lys Ala Gly Phe Glu Gly Asp Arg Thr Asn Ser Leu Arg Lys Tyr Kozak NcoI   SalI    BamHI     KpnI EcoRI              EcoRI      NotI
TTA ACC ATG GTC GAC TGG ATC CGG TAC CGA ATT C - - ccdB - - G AAT TCG CGG CCG
AAT TGG TAC CAG CTG ACC TAG GCC ATG GCT TAA G              C TTA AGC GCC GGC Leu Thr Met Val Asp Trp Ile Arg Tyr Arg Ile              Asn Ser Arg Pro XhoI   EcoRV XbaI            Int    attL2
CAC TCG AGA TAT CTA GAC CCA GCT TTC TTG TAC AAA G
GTG AGC TCT ATA GAT CTG GGT CGA AAG AAC ATG TTT C His Ser Arg Tyr Leu Asp Pro Ala Phe Leu Tyr Lys

FIG.20A pENTR11 2744 bp (rotated to position 2578)

| Location (Base Nos.) | Gene Encoded |
|---|---|
| 67..166 | attL1 |
| 348..653 | ccdB |
| 683..781 | attL2 |
| 904..1713 | KmR |
| 1818..2391 | ori |

```
   1 CTGACGGATG GCCTTTTTGC GTTTCTACAA ACTCTTCCTG TTAGTTAGTT ACTTAAGCTC
  61 GGGCCCCAAA TAATGATTTT ATTTTGACTG ATAGTGACCT GTTCGTTGCA ACAAATTGAT
 121 AAGCAATGCT TTTTTATAAT GCCAACTTTG TACAAAAAAG CAGGCTTCGA AGGAGATAGA
 181 ACCAATTCTC TAAGGAAATA CTTAACCATG GTCGACTGGA TCCGGTACCG AATTCGCTTA
 241 CTAAAAGCCA GATAACAGTA TGCGTATTTG CGCGCTGATT TTTGCGGTAT AAGAATATAT
 301 ACTGATATGT ATACCCGAAG TATGTCAAAA AGAGGTGTGC TTCTAGAATG CAGTTTAAGG
 361 TTTACACCTA TAAAAGAGAG AGCCGTTATC GTCTGTTTGT GGATGTACAG AGTGATATTA
 421 TTGACACGCC CGGGCGACGG ATAGTGATCC CCCTGGCCAG TGCACGTCTG CTGTCAGATA
 481 AAGTCTCCCG TGAACTTTAC CCGGTGGTGC ATATCGGGGA TGAAAGCTGG CGCATGATGA
 541 CCACCGATAT GGCCAGTGTG CCGGTCTCCG TTATCGGGGA AGAAGTGGCT GATCTCAGCC
 601 ACCGCGAAAA TGACATCAAA AACGCCATTA ACCTGATGTT CTGGGGAATA TAGAATTCGC
 661 GGCCGCACTC GAGATATCTA GACCCAGCTT TCTTGTACAA AGTTGGCATT ATAAGAAAGC
 721 ATTGCTTATC AATTTGTTGC AACGAACAGG TCACTATCAG TCAAAATAAA ATCATTATTT
 781 GCCATCCAGC TGCAGCTCTG GCCCGTGTCT CAAAATCTCT GATGTTACAT GCACAAGAT
 841 AAAAATATAT CATCATGAAC AATAAAACTG TCTGCTTACA TAAACAGTAA TACAAGGGGT
 901 GTTATGAGCC ATATTCAACG GGAAACGTCG AGGCCGCGAT TAAATTCCAA CATGGATGCT
 961 GATTTATATG GGTATAAATG GGCTCGCGAT AATGTCGGGC AATCAGGTGC GACAATCTAT
1021 CGCTTGTATG GGAAGCCCGA TGCGCCAGAG TTGTTTCTGA AACATGGCAA AGGTAGCGTT
1081 GCCAATGATG TTACAGATGA GATGGTCAGA CTAAACTGGC TGACGGAATT TATGCCTCTT
1141 CCGACCATCA AGCATTTTAT CCGTACTCCT GATGATGCAT GGTTACTCAC CACTGCGATC
1201 CCCGGAAAAA CAGCATTCCA GGTATTAGAA GAATATCCTG ATTCAGGTGA AAATATTGTT
1261 GATGCGCTGG CAGTGTTCCT GCGCCGGTTG CATTCGATTC CTGTTTGTAA TTGTCCTTTT
1321 AACAGCGATC GCGTATTTCG TCTCGCTCAG GCGCAATCAC GAATGAATAA CGGTTTGGTT
1381 GATGCGAGTG ATTTTGATGA CGAGCGTAAT GGCTGGCCTG TTGAACAAGT CTGGAAAGAA
1441 ATGCATAAAC TTTTGCCATT CTCACCGGAT TCAGTCGTCA CTCATGGTGA TTTCTCACTT
1501 GATAACCTTA TTTTTGACGA GGGGAAATTA ATAGGTTGTA TTGATGTTGG ACGAGTCGGA
1561 ATCGCAGACC GATACCAGGA TCTTGCCATC CTATGGAACT GCCTCGGTGA GTTTTCTCCT
1621 TCATTACAGA AACGGCTTTT TCAAAAATAT GGTATTGATA ATCCTGATAT GAATAAATTG
1681 CAGTTTCATT TGATGCTCGA TGAGTTTTTC TAATCAGAAT TGGTTAATTG GTTGTAACAT
1741 TATTCAGATT GGGCCCCGTT CCACTGAGCG TCAGACCCCG TAGAAAAGAT CAAAGGATCT
1801 TCTTGAGATC CTTTTTTTCT GCGCGTAATC TGCTGCTTGC AAACAAAAAA ACCACCGCTA
1861 CCAGCGGTGG TTTGTTTGCC GGATCAAGAG CTACCAACTC TTTTTCCGAA GGTAACTGGC
1921 TTCAGCAGAG CGCAGATACC AAATACTGTT CTTCTAGTGT AGCCGTAGTT AGGCCACCAC
1981 TTCAAGAACT CTGTAGCACC GCCTACATAC CTCGCTCTGC TAATCCTGTT ACCAGTGGCT
2041 GCTGCCAGTG GCGATAAGTC GTGTCTTACC GGGTTGGACT CAAGACGATA GTTACCGGAT
2101 AAGGCGCAGC GGTCGGGCTG AACGGGGGGT TCGTGCACAC AGCCCAGCTT GGAGCGAACG
2161 ACCTACACCG AACTGAGATA CCTACAGCGT GAGCTATGAG AAAGCGCCAC GCTTCCCGAA
2221 GGGAGAAAGG CGGACAGGTA TCCGGTAAGC GGCAGGGTCG GAACAGGAGA GCGCACGAGG
2281 GAGCTTCCAG GGGGAAACGC CTGGTATCTT TATAGTCCTG TCGGGTTTCG CCACCTCTGA
2341 CTTGAGCGTC GATTTTTGTG ATGCTCGTCA GGGGGGCGGA GCCTATGGAA AAACGCCAGC
2401 AACGCGGCCT TTTTACGGTT CCTGGCCTTT TGCTGGCCTT TTGCTCACAT GTTCTTTCCT
2461 GCGTTATCCC CTGATTCTGT GGATAACCGT ATTACCGCTA GCATGGATCT CGGGGACGTC
2521 TAACTACTAA GCGAGAGTAG GAACTGCCA GGCATCAAAT AAAACGAAAG GCTCAGTCGG
2581 AAGACTGGGC CTTTCGTTTT ATCTGTTGTT TGTCGGTGAA CGCTCTCCTG AGTAGGACAA
2641 ATCCGCCGGG AGCGGATTTG AACGTTGTGA AGCAACGGCC CGGAGGGTGG CGGGCAGGAC
2701 GCCCGCCATA AACTGCCAGG CATCAAACTA AGCAGAAGGC CATC
```

FIG.20B pDEST1 6464 bp

| Location (Base Nos.) | Gene Encoded |
|---|---|
| 216..257 | Trc promoter |
| 397..273 | attR1 |
| 647..1306 | CmR |
| 1426..1510 | inactivated ccdA |
| 1648..1953 | ccdB |
| 1994..2118 | attR2 |
| 2598..3503 | ampR |
| 4104..4264 | ori |
| 4504..4941 | flori (f1 intergenic region) |
| 5340..6420 | lacIq |

```
   1 GTTTGACAGC TTATCATCGA CTGCACGGTG CACCAATGCT TCTGGCGTCA GGCAGCCATC
  61 GGAAGCTGTG GTATGGCTGT GCAGGTCGTA AATCACTGCA TAATTCGTGT CGCTCAAGGC
 121 GCACTCCCGT TCTGGATAAT GTTTTTTGCG CCGACATCAT AACGGTTCTG GCAAATATTC
 181 TGAAATGAGC TGTTGACAAT TAATCATCCG GTCCGTATAA TCTGTGGAAT TGTGAGCGGG
 241 ATAACAATTT CATCGCGAGG TACCAAGCTA TCACAAGTTT GTACAAAAAA GCTGAACGAG
 301 AAACGTAAAA TGATATAAAT ATCAATATAT TAAATTAGAT TTTGCATAAA AAACAGACTA
 361 CATAATACTG TAAAACACAA CATATCCAGT CACTATGGCG GCCGCTAAGT TGGCAGCATC
 421 ACCCGACGCA CTTTGCGCCG AATAAAATACC TGTGACGGAA GATCACTTCG CAGAATAAAT
 481 AAATCCTGGT GTCCCTGTTG ATACCGGGAA GCCCTGGGCC AACTTTTGGC GAAAATGAGA
 541 CGTTGATCGG CACGTAAGAG GTTCCAACTT TCACCATAAT GAAATAAGAT CACTACCGGG
 601 CGTATTTTTT GAGTTATCGA GATTTTCAGG AGCTAAGGAA GCTAAAATGG AGAAAAAAAT
 661 CACTGGATAT ACCACCGTTG ATATATCCCA ATGGCATCGT AAAGAACATT TTGAGGCATT
 721 TCAGTCAGTT GCTCAATGTA CCTATAACCA GACCGTTCAG CTGGATATTA CGGCCTTTTT
 781 AAAGACCGTA AAGAAAAATA AGCACAAGTT TTATCCGGCC TTTATTCACA TTCTTGCCCG
 841 CCTGATGAAT GCTCATCCGG AATTCCGTAT GGCAATGAAA GACGGTGAGC TGGTGATATG
 901 GGATAGTGTT CACCCTTGTT ACACCGTTTT CCATGAGCAA ACTGAAACGT TTTCATCGCT
 961 CTGGAGTGAA TACCACGACG ATTTCCGGCA GTTTCTACAC ATATATTCGC AAGATGTGGC
1021 GTGTTACGGT GAAAACCTGG CCTATTTCCC TAAAGGGTTT ATTGAGAATA TGTTTTTCGT
1081 CTCAGCCAAT CCCTGGGTGA GTTTCACCAG TTTTGATTTA AACGTGGCCA ATATGGACAA
1141 CTTCTTCGCC CCCGTTTTCA CCATGGGCAA ATATTATACG CAAGGCGACA AGGTGCTGAT
1201 GCCGCTGGCG ATTCAGGTTC ATCATGCCGT CTGTGATGGC TTCCATGTCG GCAGAATGCT
1261 TAATGAATTA CAACAGTACT GCGATGAGTG GCAGGGCGGG GCGTAAACGC GTGGATCCGG
1321 CTTACTAAAA GCCAGATAAC AGTATGCGTA TTTGCGCGCT GATTTTTGCG GTATAAGAAT
1381 ATATACTGAT ATGTATACCC GAAGTATGTC AAAAAGAGGT GTGCTATGAA GCAGCGTATT
1441 ACAGTGACAG TTGACAGCGA CAGCTATCAG TTGCTCAAGG CATATATGAT GTCAATATCT
1501 CCGGTCTGGT AAGCACAACC ATGCAGAATG AAGCCCGTCG TCTGCGTGCC GAACGCTGGA
1561 AAGCGGAAAA TCAGGAAGGG ATGGCTGAGG TCGCCCGGTT TATTGAAATG AACGGCTCTT
1621 TTGCTGACGA GAACAGGGAC TGGTGAAATG CAGTTTAAGG TTTACACCTA TAAAAGAGAG
1681 AGCCGTTATC GTCTGTTTGT GGATGTACAG AGTGATATTA TTGACACGCC CGGGCGACGG
```

FIG.21B

```
1741 ATGGTGATCC CCCTGGCCAG TGCACGTCTG CTGTCAGATA AAGTCTCCCG TGAACTTTAC
1801 CCGGTGGTGC ATATCGGGGA TGAAAGCTGG CGCATGATGA CCACCGATAT GGCCAGTGTG
1861 CCGGTCTCCG TTATCGGGGA AGAAGTGGCT GATCTCAGCC ACCGCGAAAA TGACATCAAA
1921 AACGCCATTA ACCTGATGTT CTGGGGAATA TAAATGTCAG GCTCCCTTAT ACACAGCCAG
1981 TCTGCAGGTC GACCATAGTG ACTGGATATG TTGTGTTTTA CAGTATTATG TAGTCTGTTT
2041 TTTATGCAAA ATCTAATTTA ATATATTGAT ATTTATATCA TTTTACGTTT CTCGTTCAGC
2101 TTTCTTGTAC AAAGTGGTGA TAGCTTGGCT GTTTTGGCGG ATGAGAGAAG ATTTTCAGCC
2161 TGATACAGAT TAAATCAGAA CGCAGAAGCG GTCTGATAAA ACAGAATTTG CCTGGCGGCA
2221 GTAGCGCGGT GGTCCCACCT GACCCCATGC CGAACTCAGA AGTGAAACGC CGTAGCGCCG
2281 ATGGTAGTGT GGGGTCTCCC CATGCGAGAG TAGGGAACTG CCAGGCATCA AATAAAACGA
2341 AAGGCTCAGT CGAAAGACTG GGCCTTTCGT TTTATCTGTT GTTTGTCGGT GAACGCTCTC
2401 CTGAGTAGGA CAAATCCGCC GGGAGCGGAT TTGAACGTTG CGAAGCAACG GCCCGGAGGG
2461 TGGCGGGCAG GACGCCCGCC ATAAACTGCC AGGCATCAAA TTAAGCAGAA GGCCATCCTG
2521 ACGGATGGCC TTTTTGCGTT TCTACAAACT CTTTTTGTTT ATTTTTCTAA ATACATTCAA
2581 ATATGTATCC GCTCATGAGA CAATAACCCT GATAAATGCT TCAATAATAT TGAAAAAGGA
2641 AGAGTATGAG TATTCAACAT TTCCGTGTCG CCCTTATTCC CTTTTTTGCG GCATTTTGCC
2701 TTCCTGTTTT TGCTCACCCA GAAACGCTGG TGAAAGTAAA AGATGCTGAA GATCAGTTGG
2761 GTGCACGAGT GGGTTACATC GAACTGGATC TCAACAGCGG TAAGATCCTT GAGAGTTTTC
2821 GCCCCGAAGA ACGTTTTCCA ATGATGAGCA CTTTTAAAGT TCTGCTATGT GGCGCGGTAT
2881 TATCCCGTGT TGACGCCGGG CAAGAGCAAC TCGGTCGCCG CATACACTAT TCTCAGAATG
2941 ACTTGGTTGA GTACTCACCA GTCACAGAAA AGCATCTTAC GGATGGCATG ACAGTAAGAG
3001 AATTATGCAG TGCTGCCATA ACCATGAGTG ATAACACTGC GGCCAACTTA CTTCTGACAA
3061 CGATCGGAGG ACCGAAGGAG CTAACCGCTT TTTTGCACAA CATGGGGGAT CATGTAACTC
3121 GCCTTGATCG TTGGGAACCG GAGCTGAATG AAGCCATACC AAACGACGAG CGTGACACCA
3181 CGATGCCTAC AGCAATGGCA ACAACGTTGC GCAAACTATT AACTGGCGAA CTACTTACTC
3241 TAGCTTCCCG GCAACAATTA ATAGACTGGA TGGAGGCGGA TAAAGTTGCA GGACCACTTC
3301 TGCGCTCGGC CCTTCCGGCT GGCTGGTTTA TTGCTGATAA ATCTGGAGCC GGTGAGCGTG
3361 GGTCTCGCGG TATCATTGCA GCACTGGGGC CAGATGGTAA GCCCTCCCGT ATCGTAGTTA
3421 TCTACACGAC GGGGAGTCAG GCAACTATGG ATGAACGAAA TAGACAGATC GCTGAGATAG
3481 GTGCCTCACT GATTAAGCAT TGGTAACTGT CAGACCAAGT TTACTCATAT ATACTTTAGA
3541 TTGATTTAAA ACTTCATTTT TAATTTAAAA GGATCTAGGT GAAGATCCTT TTTGATAATC
3601 TCATGACCAA AATCCCTTAA CGTGAGTTTT CGTTCCACTG AGCGTCAGAC CCCGTAGAAA
3661 AGATCAAAGG ATCTTCTTGA GATCCTTTTT TTCTGCGCGT AATCTGCTGC TTGCAAACAA
3721 AAAAACCACC GCTACCAGCG GTGGTTTGTT TGCCGGATCA AGAGCTACCA ACTCTTTTTC
3781 CGAAGGTAAC TGGCTTCAGC AGAGCGCAGA TACCAAATAC TGTCCTTCTA GTGTAGCCGT
3841 AGTTAGGCCA CCACTTCAAG AACTCTGTAG CACCGCCTAC ATACCTCGCT CTGCTAATCC
3901 TGTTACCAGT GGCTGCTGCC AGTGGCGATA AGTCGTGTCT TACCGGGTTG GACTCAAGAC
3961 GATAGTTACC GGATAAGGCG CAGCGGTCGG GCTGAACGGG GGGTTCGTGC ACACAGCCCA
4021 GCTTGGAGCG AACGACCTAC ACCGAACTGA GATACCTACA GCGTGAGCTA TGAGAAAGCG
4081 CCACGCTTCC CGAAGGGAGA AAGGCGGACA GGTATCCGGT AAGCGGCAGG GTCGGAACAG
4141 GAGAGCGCAC GAGGGAGCTT CCAGGGGGAA ACGCCTGGTA TCTTTATAGT CCTGTCGGGT
```

FIG.21C

```
4201 TTCGCCACCT CTGACTTGAG CGTCGATTTT TGTGATGCTC GTCAGGGGGG CGGAGCCTAT
4261 GGAAAAACGC CAGCAACGCG GCCTTTTTAC GGTTCCTGGC CTTTTGCTGG CCTTTTGCTC
4321 ACATGTTCTT TCCTGCGTTA TCCCCTGATT CTGTGGATAA CCGTATTACC GCCTTTGAGT
4381 GAGCTGATAC CGCTCGCCGC AGCCGAACGA CCGAGCGCAG CGAGTCAGTG AGCGAGGAAG
4441 CGGAAGAGCG CCTGATGCGG TATTTTCTCC TTACGCATCT GTGCGGTATT TCACACCGCA
4501 TAATTTTGTT AAAATTCGCG TTAAATTTTT GTTAAATCAG CTCATTTTTT AACCAATAGG
4561 CCGAAATCGG CAAAATCCCT TATAAATCAA AGAATAGAC CGAGATAGGG TTGAGTGTTG
4621 TTCCAGTTTG GAACAAGAGT CCACTATTAA AGAACGTGGA CTCCAACGTC AAAGGGCGAA
4681 AAACCGTCTA TCAGGGCGAT GGCCCACTAC GTGAACCATC ACCCTAATCA AGTTTTTTGG
4741 GGTCGAGGTG CCGTAAAGCA CTAAATCGGA ACCCTAAAGG GAGCCCCCGA TTTAGAGCTT
4801 GACGGGGAAA GCCGGCGAAC GTGGCGAGAA AGGAAGGGAA GAAAGCGAAA GGAGCGGGCG
4861 CTAGGGCGCT GGCAAGTGTA GCGGTCACGC TGCGCGTAAC CACCACACCC GCCGCGCTTA
4921 ATGCGCCGCT ACAGGGCGCG TCCATTCGCC ATTCAGGCTG CTATGGTGCA CTCTCAGTAC
4981 AATCTGCTCT GATGCCGCAT AGTTAAGCCA GTACCAGTCA CGTAGCGATA TCGGAGTGTA
5041 TACACTCCGC TATCGCTACG TGACTGGGTC ATGGCTGCGC CCCGACACCC GCCAACACCC
5101 GCTGACGCGC CCTGACGGGC TTGTCTGCTC CCGGCATCCG CTTACAGACA AGCTGTGACC
5161 GTCTCCGGGA GCTGCATGTG TCAGAGGTTT TCACCGTCAT CACCGAAACG CGCGAGGCAG
5221 CAGATCAATT CGCGCGCGAA GGCGAAGCGG CATGCATTTA CGTTGACACC ATCGAATGGT
5281 GCAAAACCTT TCGCGGTATG GCATGATAGC GCCCGGAAGA GAGTCAATTC AGGGTGGTGA
5341 ATGTGAAACC AGTAACGTTA TACGATGTCG CAGAGTATGC CGGTGTCTCT TATCAGACCG
5401 TTTCCCGCGT GGTGAACCAG GCCAGCCACG TTTCTGCGAA AACGCGGGAA AAAGTGGAAG
5461 CGGCGATGGC GGAGCTGAAT TACATTCCCA ACCGCGTGGC ACAACAACTG GCGGGCAAAC
5521 AGTCGTTGCT GATTGGCGTT GCCACCTCCA GTCTGGCCCT GCACGCGCCG TCGCAAATTG
5581 TCGCGGCGAT TAAATCTCGC GCCGATCAAC TGGGTGCCAG CGTGGTGGTG TCGATGGTAG
5641 AACGAAGCGG CGTCGAAGCC TGTAAAGCGG CGGTGCACAA TCTTCTCGCG CAACGCGTCA
5701 GTGGGCTGAT CATTAACTAT CCGCTGGATG ACCAGGATGC CATTGCTGTG GAAGCTGCCT
5761 GCACTAATGT TCCGGCGTTA TTTCTTGATG TCTCTGACCA GACACCCATC AACAGTATTA
5821 TTTTCTCCCA TGAAGACGGT ACGCGACTGG GCGTGGAGCA TCTGGTCGCA TTGGGTCACC
5881 AGCAAATCGC GCTGTTAGCG GGCCCATTAA GTTCTGTCTC GGCGCGTCTG CGTCTGGCTG
5941 GCTGGCATAA ATATCTCACT CGCAATCAAA TTCAGCCGAT AGCGGAACGG GAAGGCGACT
6001 GGAGTGCCAT GTCCGGTTTT CAACAAACCA TGCAAATGCT GAATGAGGGC ATCGTTCCCA
6061 CTGCGATGCT GGTTGCCAAC GATCAGATGG CGCTGGGCGC AATGCGCGCC ATTACCGAGT
6121 CCGGGCTGCG CGTTGGTGCG GATATCTCGG TAGTGGGATA CGACGATACC GAAGACAGCT
6181 CATGTTATAT CCCGCCGTTA ACCACCATCA AACAGGATTT TCGCCTGCTG GGGCAAACCA
6241 GCGTGGACCG CTTGCTGCAA CTCTCTCAGG GCCAGGCGGT GAAGGGCAAT CAGCTGTTGC
6301 CCGTCTCACT GGTGAAAAGA AAAACCACCC TGGCACCCAA TACGCAAACC GCCTCTCCCC
6361 GCGCGTTGGC CGATTCATTA ATGCAGCTGG CACGACAGGT TTCCCGACTG GAAAGCGGGC
6421 AGTGAGCGCA ACGCAATTAA TGTGAGTTAG CGCGAATTGA TCTG
```

FIG. 21D pDEST2 6553 bp

| Location (Base Nos.) | Gene Encoded |
|---|---|
| 912..962 | Trc |
| 1223..1009 | attR1 |
| 1473..2132 | CmR |
| 2252..2336 | inactivated ccdA |
| 2474..2779 | ccdB |
| 2820..2944 | attR2 |
| 3509..4414 | ampR |
| 5015..5175 | ori |
| 5415..5852 | flori (f1 intergenic region) |
| 6225..752 | lacIq |

```
   1 GGCGGTGCAC AATCTTCTCG CGCAACGCGT CAGTGGGCTG ATCATTAACT ATCCGCTGGA
  61 TGACCAGGAT GCCATTGCTG TGGAAGCTGC CTGCACTAAT GTTCCGGCGT TATTTCTTGA
 121 TGTCTCTGAC CAGACACCCA TCAACAGTAT TATTTTCTCC CATGAAGACG GTACGCGACT
 181 GGGCGTGGAG CATCTGGTCG CATTGGGTCA CCAGCAAATC GCGCTGTTAG CGGGCCCATT
 241 AAGTTCTGTC TCGGCGCGTC TGCGTCTGGC TGGCTGGCAT AAATATCTCA CTCGCAATCA
 301 AATTCAGCCG ATAGCGGAAC GGGAAGGCGA CTGGAGTGCC ATGTCCGGTT TTCAACAAAC
 361 CATGCAAATG CTGAATGAGG GCATCGTTCC CACTGCGATG CTGGTTGCCA ACGATCAGAT
 421 GGCGCTGGGC GCAATGCGCG CCATTACCGA GTCCGGGCTG CGCGTTGGTG CGGATATCTC
 481 GGTAGTGGGA TACGACGATA CCGAAGACAG CTCATGTTAT ATCCCGCCGT CAACCACCAT
 541 CAAACAGGAT TTTCGCCTGC TGGGGCAAAC CAGCGTGGAC CGCTTGCTGC AACTCTCTCA
 601 GGGCCAGGCG GTGAAGGGCA ATCAGCTGTT GCCCGTCTCA CTGGTGAAAA GAAAAACCAC
 661 CCTGGCACCC AATACGCAAA CCGCCTCTCC CCGCGCGTTG GCCGATTCAT TAATGCAGCT
 721 GGCACGACAG GTTTCCCGAC TGGAAAGCGG GCAGTGAGCG CAACGCAATT AATGTGAGTT
 781 AGCGCGAATT GATCTGGTTT GACAGCTTAT CATCGACTGC ACGGTGCACC AATGCTTCTG
 841 GCGTCAGGCA GCCATCGGAA GCTGTGGTAT GGCTGTGCAG GTCGTAAATC ACTGCATAAT
 901 TCGTGTCGCT CAAGGCGCAC TCCCGTTCTG GATAATGTTT TTTGCGCCGA CATCATAACG
 961 GTTCTGGCAA ATATTCTGAA ATGAGCTGTT GACAATTAAT CATCCGGTCC GTATAATCTG
1021 TGGAATTGTG AGCGGATAAC AATTTCACAC AGGAAACAGA CCATGTCGTA CTACCATCAC
1081 CATCACCATC ACGGCATCAC AAGTTTGTAC AAAAAAGCTG AACGAGAAAC GTAAAATGAT
1141 ATAAATATCA ATATATTAAA TTAGATTTTG CATAAAAAAC AGACTACATA ATACTGTAAA
1201 ACACAACATA TCCAGTCACT ATGGCGGCCG CTAAGTTGGC AGCATCACCC GACGCACTTT
1261 GCGCCGAATA AATACCTGTG ACGGAAGATC ACTTCGCAGA ATAAATAAAT CCTGGTGTCC
1321 CTGTTGATAC CGGGAAGCCC TGGGCCAACT TTTGGCGAAA ATGAGACGTT GATCGGCACG
1381 TAAGAGGTTC CAACTTTCAC CATAATGAAA TAAGATCACT ACCGGGCGTA TTTTTTGAGT
1441 TATCGAGATT TTCAGGAGCT AAGGAAGCTA AAATGGAGAA AAAAATCACT GGATATACCA
1501 CCGTTGATAT ATCCCAATGG CATCGTAAAG AACATTTTGA GGCATTTCAG TCAGTTGCTC
1561 AATGTACCTA TAACCAGACC GTTCAGCTGG ATATTACGGC CTTTTTAAAG ACCGTAAAGA
1621 AAAATAAGCA CAAGTTTTAT CCGGCCTTTA TTCACATTCT TGCCCGCCTG ATGAATGCTC
1681 ATCCGGAATT CCGTATGGCA ATGAAAGACG GTGAGCTGGT GATATGGGAT AGTGTTCACC
```

FIG.22B

```
1741 CTTGTTACAC CGTTTTCCAT GAGCAAACTG AAACGTTTTC ATCGCTCTGG AGTGAATACC
1801 ACGACGATTT CCGGCAGTTT CTACACATAT ATTCGCAAGA TGTGGCGTGT TACGGTGAAA
1861 ACCTGGCCTA TTTCCCTAAA GGGTTTATTG AGAATATGTT TTTCGTCTCA GCCAATCCCT
1921 GGGTGAGTTT CACCAGTTTT GATTTAAACG TGGCCAATAT GGACAACTTC TTCGCCCCCG
1981 TTTTCACCAT GGGCAAATAT TATACGCAAG GCGACAAGGT GCTGATGCCG CTGGCGATTC
2041 AGGTTCATCA TGCCGTCTGT GATGGCTTCC ATGTCGGCAG AATGCTTAAT GAATTACAAC
2101 AGTACTGCGA TGAGTGGCAG GGCGGGGCGT AAACGCGTGG ATCCGGCTTA CTAAAAGCCA
2161 GATAACAGTA TGCGTATTTG CGCGCTGATT TTTGCGGGTAT AAGAATATAT ACTGATATGT
2221 ATACCCGAAG TATGTCAAAA AGAGGTGTGC TATGAAGCAG CGTATTACAG TGACAGTTGA
2281 CAGCGACAGC TATCAGTTGC TCAAGGCATA TATGATGTCA ATATCTCCGG TCTGGTAAGC
2341 ACAACCATGC AGAATGAAGC CCGTCGTCTG CGTGCCGAAC GCTGGAAAGC GGAAAATCAG
2401 GAAGGGATGG CTGAGGTCGC CCGGTTTATT GAAATGAACG GCTCTTTTGC TGACGAGAAC
2461 AGGGACTGGT GAAATGCAGT TTAAGGTTTA CACCTATAAA AGAGAGAGCC GTTATCGTCT
2521 GTTTGTGGAT GTACAGAGTG ATATTATTGA CACGCCCGGG CGACGGATGG TGATCCCCCT
2581 GGCCAGTGCA CGTCTGCTGT CAGATAAAGT CTCCCGTGAA CTTTACCCGG TGGTGCATAT
2641 CGGGGATGAA AGCTGGCGCA TGATGACCAC CGATATGGCC AGTGTGCCGG TCTCCGTTAT
2701 CGGGGAAGAA GTGGCTGATC TCAGCCACCG CGAAAATGAC ATCAAAAACG CCATTAACCT
2761 GATGTTCTGG GGAATATAAA TGTCAGGCTC CCTTATACAC AGCCAGTCTG CAGGTCGACC
2821 ATAGTGACTG GATATGTTGT GTTTTACAGT ATTATGTAGT CTGTTTTTTA TGCAAAATCT
2881 AATTTAATAT ATTGATATTT ATATCATTTT ACGTTTCTCG TTCAGCTTTC TTGTACAAAG
2941 TGGTGATGCC CATATGGGAA TTCAAAGGCC TACGTCGACG AGCTCACTAG TCGCGGCCGC
3001 TTCTAGAGGA TCCCTCGAGG CATGCGGTAC CAAGCTTGGC TGTTTTGGCG GATGAGAGAA
3061 GATTTTCAGC CTGATACAGA TTAAATCAGA ACGCAGAAGC GGTCTGATAA AACAGAATTT
3121 GCCTGGCGGC AGTAGCGCGG TGGTCCCACC TGACCCCATG CCGAACTCAG AAGTGAAACG
3181 CCGTAGCGCC GATGGTAGTG TGGGGTCTCC CCATGCGAGA GTAGGGAACT GCCAGGCATC
3241 AAATAAAACG AAAGGCTCAG TCGAAAGACT GGGCCTTTCG TTTTATCTGT TGTTTGTCGG
3301 TGAACGCTCT CCTGAGTAGG ACAAATCCGC CGGGAGCGGA TTTGAACGTT GCGAAGCAAC
3361 GGCCCGGAGG GTGGCGGGCA GGACGCCCGC CATAAACTGC CAGGCATCAA ATTAAGCAGA
3421 AGGCCATCCT GACGGATGGC CTTTTTGCGT TTCTACAAAC TCTTTTTGTT TATTTTTCTA
3481 AATACATTCA AATATGTATC CGCTCATGAG ACAATAACCC TGATAAATGC TTCAATAATA
3541 TTGAAAAAGG AAGAGTATGA GTATTCAACA TTTCCGTGTC GCCCTTATTC CCTTTTTTGC
3601 GGCATTTTGC CTTCCTGTTT TTGCTCACCC AGAAACGCTG GTGAAAGTAA AAGATGCTGA
3661 AGATCAGTTG GGTGCACGAG TGGGTTACAT CGAACTGGAT CTCAACAGCG GTAAGATCCT
3721 TGAGAGTTTT CGCCCCGAAG AACGTTTTCC AATGATGAGC ACTTTTAAAG TTCTGCTATG
3781 TGGCGCGGTA TTATCCCGTG TTGACGCCGG GCAAGAGCAA CTCGGTCGCC GCATACACTA
3841 TTCTCAGAAT GACTTGGTTG AGTACTCACC AGTCACAGAA AAGCATCTTA CGGATGGCAT
3901 GACAGTAAGA GAATTATGCA GTGCTGCCAT AACCATGAGT GATAACACTG CGGCCAACTT
3961 ACTTCTGACA ACGATCGGAG GACCGAAGGA GCTAACCGCT TTTTTGCACA ACATGGGGGA
4021 TCATGTAACT CGCCTTGATC GTTGGGAACC GGAGCTGAAT GAAGCCATAC CAAACGACGA
4081 GCGTGACACC ACGATGCCTA CAGCAATGGC AACAACGTTG CGCAAACTAT TAACTGGCGA
4141 ACTACTTACT CTAGCTTCCC GGCAACAATT AATAGACTGG ATGGAGGCGG ATAAAGTTGC
```

FIG.22C

```
4201 AGGACCACTT CTGCGCTCGG CCCTTCCGGC TGGCTGGTTT ATTGCTGATA AATCTGGAGC
4261 CGGTGAGCGT GGGTCTCGCG GTATCATTGC AGCACTGGGG CCAGATGGTA AGCCCTCCCG
4321 TATCGTAGTT ATCTACACGA CGGGGAGTCA GGCAACTATG GATGAACGAA ATAGACAGAT
4381 CGCTGAGATA GGTGCCTCAC TGATTAAGCA TTGGTAACTG TCAGACCAAG TTTACTCATA
4441 TATACTTTAG ATTGATTTAA AACTTCATTT TTAATTTAAA AGGATCTAGG TGAAGATCCT
4501 TTTTGATAAT CTCATGACCA AAATCCCTTA ACGTGAGTTT TCGTTCCACT GAGCGTCAGA
4561 CCCCGTAGAA AAGATCAAAG GATCTTCTTG AGATCCTTTT TTTCTGCGCG TAATCTGCTG
4621 CTTGCAAACA AAAAAACCAC CGCTACCAGC GGTGGTTTGT TTGCCGGATC AAGAGCTACC
4681 AACTCTTTTT CCGAAGGTAA CTGGCTTCAG CAGAGCGCAG ATACCAAATA CTGTCCTTCT
4741 AGTGTAGCCG TAGTTAGGCC ACCACTTCAA GAACTCTGTA GCACCGCCTA CATACCTCGC
4801 TCTGCTAATC CTGTTACCAG TGGCTGCTGC CAGTGGCGAT AAGTCGTGTC TTACCGGGTT
4861 GGACTCAAGA CGATAGTTAC CGGATAAGGC GCAGCGGTCG GGCTGAACGG GGGGTTCGTG
4921 CACACAGCCC AGCTTGGAGC GAACGACCTA CACCGAACTG AGATACCTAC AGCGTGAGCT
4981 ATGAGAAAGC GCCACGCTTC CCGAAGGGAG AAAGGCGGAC AGGTATCCGG TAAGCGGCAG
5041 GGTCGGAACA GGAGAGCGCA CGAGGGAGCT TCCAGGGGGA AACGCCTGGT ATCTTTATAG
5101 TCCTGTCGGG TTTCGCCACC TCTGACTTGA GCGTCGATTT TTGTGATGCT CGTCAGGGGG
5161 GCGGAGCCTA TGGAAAAACG CCAGCAACGC GGCCTTTTTA CGGTTCCTGG CCTTTTGCTG
5221 GCCTTTTGCT CACATGTTCT TTCCTGCGTT ATCCCCTGAT TCTGTGGATA ACCGTATTAC
5281 CGCCTTTGAG TGAGCTGATA CCGCTCGCCG CAGCCGAACG ACCGAGCGCA GCGAGTCAGT
5341 GAGCGAGGAA GCGGAAGAGC GCCTGATGCG GTATTTTCTC CTTACGCATC TGTGCGGTAT
5401 TTCACACCGC ATAATTTTGT TAAAATTCGC GTTAAATTTT TGTTAAATCA GCTCATTTTT
5461 TAACCAATAG GCCGAAATCG GCAAAATCCC TTATAAATCA AAAGAATAGA CCGAGATAGG
5521 GTTGAGTGTT GTTCCAGTTT GGAACAAGAG TCCACTATTA AGAACGTGG ACTCCAACGT
5581 CAAAGGGCGA AAAACCGTCT ATCAGGGCGA TGGCCCACTA CGTGAACCAT CACCCTAATC
5641 AAGTTTTTTG GGGTCGAGGT GCCGTAAAGC ACTAAATCGG AACCCTAAAG GGAGCCCCCG
5701 ATTTAGAGCT TGACGGGGAA AGCCGGCGAA CGTGGCGAGA AAGGAAGGGA AGAAAGCGAA
5761 AGGAGCGGGC GCTAGGGCGC TGGCAAGTGT AGCGGTCACG CTGCGCGTAA CCACCACACC
5821 CGCCGCGCTT AATGCGCCGC TACAGGGCGC GTCCCATTCG CCATTCAGGC TGCTATGGTG
5881 CACTCTCAGT ACAATCTGCT CTGATGCCGC ATAGTTAAGC CAGTATACAC TCCGCTATCG
5941 CTACGTGACT GGGTCATGGC TGCGCCCCGA CACCCGCCAA CACCCGCTGA CGCGCCCTGA
6001 CGGGCTTGTC TGCTCCCGGC ATCCGCTTAC AGACAAGCTG TGACCGTCTC CGGGAGCTGC
6061 ATGTGTCAGA GGTTTTCACC GTCATCACCG AAACGCGCGA GGCAGCAGAT CAATTCGCGC
6121 GCGAAGGCGA AGCGGCATGC ATTTACGTTG ACACCATCGA ATGGTGCAAA ACCTTTCGCG
6181 GTATGGCATG ATAGCGCCCG GAAGAGAGTC AATTCAGGGT GGTGAATGTG AAACCAGTAA
6241 CGTTATACGA TGTCGCAGAG TATGCCGGTG TCTCTTATCA GACCGTTTCC CGCGTGGTGA
6301 ACCAGGCCAG CCACGTTTCT GCGAAAACGC GGGAAAAAGT GGAAGCGGCG ATGGCGGAGC
6361 TGAATTACAT TCCCAACCGC GTGGCACAAC AACTGGCGGG CAAACAGTCG TTGCTGATTG
6421 GCGTTGCCAC CTCCAGTCTG GCCCTGCACG CGCCGTCGCA AATTGTCGCG GCGATTAAAT
6481 CTCGCGCCGA TCAACTGGGT GCCAGCGTGG TGGTGTCGAT GGTAGAACGA AGCGGCGTCG
6541 AAGCCTGTAA AGC
```

FIG.22D pDEST3 6823 bp

| Location (Base Nos.) | Gene Encoded |
|---|---|
| 150..200 | Trc |
| 1087..963 | attR1 |
| 1337..1996 | CmR |
| 2116..2200 | inactivated ccdA |
| 2338..2643 | ccdB |
| 2684..2808 | attR2 |
| 3231..4091 | ampR |
| 5295..6254 | lacIq |

```
   1 ACGTTATCGA CTGCACGGTG CACCAATGCT TCTGGCGTCA GGCAGCCATC GGAAGCTGTG
  61 GTATGGCTGT GCAGGTCGTA AATCACTGCA TAATTCGTGT CGCTCAAGGC GCACTCCCGT
 121 TCTGGATAAT GTTTTTTGCG CCGACATCAT AACGGTTCTG GCAAATATTC TGAAATGAGC
 181 TGTTGACAAT TAATCATCGG CTCGTATAAT GTGTGGAATT GTGAGCGGAT AACAATTTCA
 241 CACAGGAAAC AGTATTCATG TCCCCTATAC TAGGTTATTG GAAAATTAAG GGCCTTGTGC
 301 AACCCACTCG ACTTCTTTTG GAATATCTTG AAGAAAAATA TGAAGAGCAT TTGTATGAGC
 361 GCGATGAAGG TGATAAATGG CGAAACAAAA AGTTTGAATT GGGTTTGGAG TTTCCCAATC
 421 TTCCTTATTA TATTGATGGT GATGTTAAAT TAACACAGTC TATGGCCATC ATACGTTATA
 481 TAGCTGACAA GCACAACATG TTGGGTGGTT GTCCAAAAGA GCGTGCAGAG ATTTCAATGC
 541 TTGAAGGAGC GGTTTTGGAT ATTAGATACG GTGTTTCGAG AATTGCATAT AGTAAAGACT
 601 TTGAAACTCT CAAAGTTGAT TTCTTAGCA AGCTACCTGA AATGCTGAAA ATGTTCGAAG
 661 ATCGTTTATG TCATAAAACA TATTTAAATG GTGATCATGT AACCCATCCT GACTTCATGT
 721 TGTATGACGC TCTTGATGTT GTTTTATACA TGGACCCAAT GTGCCTGGAT GCGTTCCCAA
 781 AATTAGTTTG TTTTAAAAAA CGTATTGAAG CTATCCCACA AATTGATAAG TACTTGAAAT
 841 CCAGCAAGTA TATAGCATGG CCTTTGCAGG GCTGGCAAGC CACGTTTGGT GGTGGCGACC
 901 ATCCTCCAAA ATCGGATCTG GTTCCGCGTG GATCTCGTCG TGCATCTGTT GGATCCCCAT
 961 CAACAAGTTT GTACAAAAAA GCTGAACGAG AAACGTAAAA TGATATAAAT ATCAATATAT
1021 TAAATTAGAT TTTGCATAAA AAACAGACTA CATAATACTG TAAAACACAA CATATCCAGT
1081 CACTATGGCG GCCGCTAAGT TGGCAGCATC ACCCGACGCA CTTTGCGCCG AATAAATACC
1141 TGTGACGGAA GATCACTTCG CAGAATAAAT AAATCCTGGT GTCCCTGTTG ATACCGGGAA
1201 GCCCTGGGCC AACTTTTGGC GAAAATGAGA CGTTGATCGG CACGTAAGAG GTTCCAACTT
1261 TCACCATAAT GAAATAAGAT CACTACCGGG CGTATTTTTT GAGTTATCGA GATTTTCAGG
1321 AGCTAAGGAA GCTAAAATGG AGAAAAAAAT CACTGGATAT ACCACCGTTG ATATATCCCA
1381 ATGGCATCGT AAAGAACATT TTGAGGCATT TCAGTCAGTT GCTCAATGTA CCTATAACCA
1441 GACCGTTCAG CTGGATATTA CGGCCTTTTT AAAGACCGTA AGAAAAATA AGCACAAGTT
1501 TTATCCGGCC TTTATTCACA TTCTTGCCCG CCTGATGAAT GCTCATCCGG AATTCCGTAT
1561 GGCAATGAAA GACGGTGAGC TGGTGATATG GGATAGTGTT CACCCTTGTT ACACCGTTTT
1621 CCATGAGCAA ACTGAAACGT TTTCATCGCT CTGGAGTGAA TACCACGACG ATTTCCGGCA
1681 GTTTCTACAC ATATATTCGC AAGATGTGGC GTGTTACGGT GAAAACCTGG CCTATTTCCC
1741 TAAAGGGTTT ATTGAGAATA TGTTTTTCGT CTCAGCCAAT CCCTGGGTGA GTTTCACCAG
1801 TTTTGATTTA AACGTGGCCA ATATGGACAA CTTCTTCGCC CCCGTTTTCA CCATGGGCAA
```

FIG.23B

```
1861 ATATTATACG CAAGGCGACA AGGTGCTGAT GCCGCTGGCG ATTCAGGTTC ATCATGCCGT
1921 CTGTGATGGC TTCCATGTCG GCAGAATGCT TAATGAATTA CAACAGTACT GCGATGAGTG
1981 GCAGGGCGGG GCGTAAAGAT CTGGATCCGG CTTACTAAAA GCCAGATAAC AGTATGCGTA
2041 TTTGCGCGCT GATTTTTGCG GTATAAGAAT ATATACTGAT ATGTATACCC GAAGTATGTC
2101 AAAAAGAGGT GTGCTATGAA GCAGCGTATT ACAGTGACAG TTGACAGCGA CAGCTATCAG
2161 TTGCTCAAGG CATATATGAT GTCAATATCT CCGGTCTGGT AAGCACAACC ATGCAGAATG
2221 AAGCCCGTCG TCTGCGTGCC GAACGCTGGA AAGCGGAAAA TCAGGAAGGG ATGGCTGAGG
2281 TCGCCCGGTT TATTGAAATG AACGGCTCTT TTGCTGACGA GAACAGGGAC TGGTGAAATG
2341 CAGTTTAAGG TTTACACCTA TAAAAGAGAG AGCCGTTATC GTCTGTTTGT GGATGTACAG
2401 AGTGATATTA TTGACACGCC CGGGCGACGG ATGGTGATCC CCCTGGCCAG TGCACGTCTG
2461 CTGTCAGATA AAGTCTCCCG TGAACTTTAC CCGGTGGTGC ATATCGGGGA TGAAAGCTGG
2521 CGCATGATGA CCACCGATAT GGCCAGTGTG CCGGTCTCCG TTATCGGGGA AGAAGTGGCT
2581 GATCTCAGCC ACCGCGAAAA TGACATCAAA AACGCCATTA ACCTGATGTT CTGGGGAATA
2641 TAAAATGTCAG GCTCCCTTAT ACACAGCCAG TCTGCAGGTC GACCATAGTG ACTGGATATG
2701 TTGTGTTTTA CAGTATTATG TAGTCTGTTT TTTATGCAAA ATCTAATTTA ATATATTGAT
2761 ATTTATATCA TTTTACGTTT CTCGTTCAGC TTTCTTGTAC AAAGTGGTTG ATGGGAATTC
2821 ATCGTGACTG ACTGACGATC TGCCTCGCGC GTTTCGGTGA TGACGGTGAA AACCTCTGAC
2881 ACATGCAGCT CCCGGAGACG GTCACAGCTT GTCTGTAAGC GGATGCCGGG AGCAGACAAG
2941 CCCGTCAGGG CGCGTCAGCG GGTGTTGGCG GGTGTCGGGG CGCAGCCATG ACCCAGTCAC
3001 GTAGCGATAG CGGAGTGTAT AATTCTTGAA GACGAAAGGG CCTCGTGATA CGCCTATTTT
3061 TATAGGTTAA TGTCATGATA ATAATGGTTT CTTAGACGTC AGGTGGCACT TTTCGGGGAA
3121 ATGTGCGCGG AACCCCTATT TGTTTATTTT TCTAAATACA TTCAAATATG TATCCGCTCA
3181 TGAGACAATA ACCCTGATAA ATGCTTCAAT AATATTGAAA AAGGAAGAGT ATGAGTATTC
3241 AACATTTCCG TGTCGCCCTT ATTCCCTTTT TTGCGGCATT TTGCCTTCCT GTTTTTGCTC
3301 ACCCAGAAAC GCTGGTGAAA GTAAAAGATG CTGAAGATCA GTTGGGTGCA CGAGTGGGTT
3361 ACATCGAACT GGATCTCAAC AGCGGTAAGA TCCTTGAGAG TTTTCGCCCC GAAGAACGTT
3421 TTCCAATGAT GAGCACTTTT AAAGTTCTGC TATGTGGCGC GGTATTATCC CGTGTTGACG
3481 CCGGGCAAGA GCAACTCGGT CGCCGCATAC ACTATTCTCA GAATGACTTG GTTGAGTACT
3541 CACCAGTCAC AGAAAAGCAT CTTACGGATG GCATGACAGT AAGAGAATTA TGCAGTGCTG
3601 CCATAACCAT GAGTGATAAC ACTGCGGCCA ACTTACTTCT GACAACGATC GGAGGACCGA
3661 AGGAGCTAAC CGCTTTTTTG CACAACATGG GGGATCATGT AACTCGCCTT GATCGTTGGG
3721 AACCGGAGCT GAATGAAGCC ATACCAAACG ACGAGCGTGA CACCACGATG CCTGCAGCAA
3781 TGGCAACAAC GTTGCGCAAA CTATTAACTG GCGAACTACT TACTCTAGCT TCCCGGCAAC
3841 AATTAATAGA CTGGATGGAG GCGGATAAAG TTGCAGGACC ACTTCTGCGC TCGGCCCTTC
3901 CGGCTGGCTG GTTTATTGCT GATAAATCTG GAGCCGGTGA GCGTGGGTCT CGCGGTATCA
3961 TTGCAGCACT GGGGCCAGAT GGTAAGCCCT CCCGTATCGT AGTTATCTAC ACGACGGGGA
4021 GTCAGGCAAC TATGGATGAA CGAAATAGAC AGATCGCTGA GATAGGTGCC TCACTGATTA
4081 AGCATTGGTA ACTGTCAGAC CAAGTTTACT CATATATACT TTAGATTGAT TTAAAACTTC
4141 ATTTTTAATT TAAAAGGATC TAGGTGAAGA TCCTTTTTGA TAATCTCATG ACCAAAATCC
4201 CTTAACGTGA GTTTTCGTTC CACTGAGCGT CAGACCCCGT AGAAAAGATC AAAGGATCTT
4261 CTTGAGATCC TTTTTTTCTG CGCGTAATCT GCTGCTTGCA AACAAAAAAA CCACCGCTAC
```

FIG.23C

```
4321 CAGCGGTGGT TTGTTTGCCG GATCAAGAGC TACCAACTCT TTTTCCGAAG GTAACTGGCT
4381 TCAGCAGAGC GCAGATACCA AATACTGTCC TTCTAGTGTA GCCGTAGTTA GGCCACCACT
4441 TCAAGAACTC TGTAGCACCG CCTACATACC TCGCTCTGCT AATCCTGTTA CCAGTGGCTG
4501 CTGCCAGTGG CGATAAGTCG TGTCTTACCG GGTTGGACTC AAGACGATAG TTACCGGATA
4561 AGGCGCAGCG GTCGGGCTGA ACGGGGGGTT CGTGCACACA GCCCAGCTTG GAGCGAACGA
4621 CCTACACCGA ACTGAGATAC CTACAGCGTG AGCTATGAGA AAGCGCCACG CTTCCCGAAG
4681 GGAGAAAGGC GGACAGGTAT CCGGTAAGCG GCAGGGTCGG AACAGGAGAG CGCACGAGGG
4741 AGCTTCCAGG GGGAAACGCC TGGTATCTTT ATAGTCCTGT CGGGTTTCGC CACCTCTGAC
4801 TTGAGCGTCG ATTTTTGTGA TGCTCGTCAG GGGGGCGGAG CCTATGGAAA AACGCCAGCA
4861 ACGCGGCCTT TTTACGGTTC CTGGCCTTTT GCTGGCCTTT TGCTCACATG TTCTTTCCTG
4921 CGTTATCCCC TGATTCTGTG GATAACCGTA TTACCGCCTT TGAGTGAGCT GATACCGCTC
4981 GCCGCAGCCG AACGACCGAG CGCAGCGAGT CAGTGAGCGA GGAAGCGGAA GAGCGCCTGA
5041 TGCGGTATTT TCTCCTTACG CATCTGTGCG GTATTTCACA CCGCATAAAT TCCGACACCA
5101 TCGAATGGTG CAAAACCTTT CGCGGTATGG CATGATAGCG CCCGGAAGAG AGTCAATTCA
5161 GGGTGGTGAA TGTGAAACCA GTAACGTTAT ACGATGTCGC AGAGTATGCC GGTGTCTCTT
5221 ATCAGACCGT TTCCCGCGTG GTGAACCAGG CCAGCCACGT TTCTGCGAAA ACGCGGGAAA
5281 AAGTGGAAGC GGCGATGGCG GAGCTGAATT ACATTCCCAA CCGCGTGGCA CAACAACTGG
5341 CGGGCAAACA GTCGTTGCTG ATTGGCGTTG CCACCTCCAG TCTGGCCCTG CACGCGCCGT
5401 CGCAAATTGT CGCGGCGATT AAATCTCGCG CCGATCAACT GGGTGCCAGC GTGGTGGTGT
5461 CGATGGTAGA ACGAAGCGGC GTCGAAGCCT GTAAAGCGGC GGTGCACAAT CTTCTCGCGC
5521 AACGCGTCAG TGGGCTGATC ATTAACTATC CGCTGGATGA CCAGGATGCC ATTGCTGTGG
5581 AAGCTGCCTG CACTAATGTT CCGGCGTTAT TTCTTGATGT CTCTGACCAG ACACCCATCA
5641 ACAGTATTAT TTTCTCCCAT GAAGACGGTA CGCGACTGGG CGTGGAGCAT CTGGTCGCAT
5701 TGGGTCACCA GCAAATCGCG CTGTTAGCGG GCCCATTAAG TTCTGTCTCG GCGCGTCTGC
5761 GTCTGGCTGG CTGGCATAAA TATCTCACTC GCAATCAAAT TCAGCCGATA GCGGAACGGG
5821 AAGGCGACTG GAGTGCCATG TCCGGTTTTC AACAAACCAT GCAAATGCTG AATGAGGGCA
5881 TCGTTCCCAC TGCGATGCTG GTTGCCAACG ATCAGATGGC GCTGGGCGCA ATGCGCGCCA
5941 TTACCGAGTC CGGGCTGCGC GTTGGTGCGG ATATCTCGGT AGTGGGATAC GACGATACCG
6001 AAGACAGCTC ATGTTATATC CCGCCGTTAA CCACCATCAA ACAGGATTTT CGCCTGCTGG
6061 GGCAAACCAG CGTGGACCGC TTGCTGCAAC TCTCTCAGGG CCAGGCGGTG AAGGGCAATC
6121 AGCTGTTGCC CGTCTCACTG GTGAAAAGAA AAACCACCCT GGCGCCCAAT ACGCAAACCG
6181 CCTCTCCCCG CGCGTTGGCC GATTCATTAA TGCAGCTGGC ACGACAGGTT TCCCGACTGG
6241 AAAGCGGGCA GTGAGCGCAA CGCAATTAAT GTGAGTTAGC TCACTCATTA GGCACCCCAG
6301 GCTTTACACT TTATGCTTCC GGCTCGTATG TTGTGTGGAA TTGTGAGCGG ATAACAATTT
6361 CACACAGGAA ACAGCTATGA CCATGATTAC GGATTCACTG GCCGTCGTTT TACAACGTCG
6421 TGACTGGGAA AACCCTGGCG TTACCCAACT TAATCGCCTT GCAGCACATC CCCCTTTCGC
6481 CAGCTGGCGT AATAGCGAAG AGGCCCGCAC CGATCGCCCT TCCCAACAGT TGCGCAGCCT
6541 GAATGGCGAA TGGCGCTTTG CCTGGTTTCC GGCACCAGAA GCGGTGCCGG AAAGCTGGCT
6601 GGAGTGCGAT CTTCCTGAGG CCGATACTGT CGTCGTCCCC TCAAACTGGC AGATGCACGG
6661 TTACGATGCG CCCATCTACA CCAACGTAAC CTATCCCATT ACGGTCAATC CGCCGTTTGT
6721 TCCCACGGAG AATCCGACGG GTTGTTACTC GCTCACATTT AATGTTGATG AAAGCTGGCT
6781 ACAGGAAGGC CAGACGCGAA TTATTTTTGA TGGCGTTGGA ATT
```

FIG.23D

His6-THIOREDOXIN FUSIONS IN E. COLI

```
                                            -35       Trc PROMOTER        -10
 919 gca aat att ctg aaa tga gct g tt gac a at tac tca tcc ggt ccg  tat aat
     cgt tta taa gac ttt act cga c aa ctg t ta att agt agg cca ggc  ata ttg ┌─ mRNA                                                Met Gly
 970 ctg tgg aat tgt gag cgg ata aca att tca cac agg aaa cag acc atg ggt
     gac acc tta aca ctc gcc tat tgt taa agt gtg tcc ttt gtc tgg tac cca His6
     ┌His His His His His His┐Asp Tyr Asp Ile Pro Thr Thr Gly Asn Leu Tyr
1021  cat cat cat cat cat cac gat tac gat atc cca acg acc gaa aac ctg tat
      gta gta gta gta gta gtg cta atg cta tag ggt tgc tgg ctt ttg gac ata
      TEV PROTEASE          ├──THIOREDOXIN ── ── (~150 AMINO ACIDS)── ── ──
                 │
     Phe Gln│Gly Ala His Met Ser Asp Lys Ile Ile His Leu Thr Asp Asp Ser
1072 ttt cag ggc gcc cat atg agc gat aaa att att cac ctg act gac gac agt
     aaa gtc ccg cgg gta tac tcg cta ttt taa taa gtg gac tga ctg ctg tca
                                                                  attR1
    ─ ─ ─ ─ ─ ─
     Asp Asp Asp Asp Lys Val Pro Ile│Thr Ser Leu Tyr Lys Lys
1429 gat gac gat gac aag gta ccc atc  aca agt tt///////////////
     cta ctg cta ctg ttc cat ggg tag  tgt tca aac atg ttt//////
                                                         ↑
                                                    Int CLEAVAGE
```

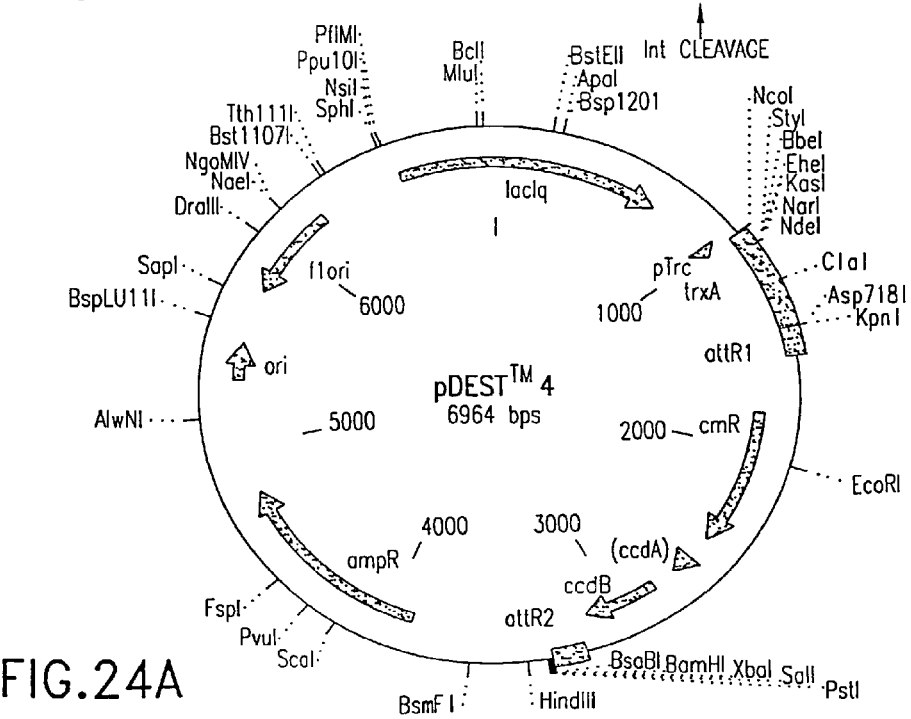

FIG.24A pDEST4 6964 bp

| Location (Base Nos.) | Gene Encoded |
|---|---|
| 964..1003 | Trc |
| 1577..1453 | attR1 |
| 1827..2486 | CmR |
| 2606..2690 | inactivated ccdA |
| 2828..3133 | ccdB |
| 3174..3298 | attR2 |
| 3872..4777 | ampR |
| 5378..5538 | ori |
| 5778..6215 | flori (f1 intergenic region) |
| 6587..704 | lacIq |

```
   1 CTATCCGCTG GATGACCAGG ATGCCATTGC TGTGGAAGCT GCCTGCACTA ATGTTCCGGC
  61 GTTATTTCTT GATGTCTCTG ACCAGACACC CATCAACAGT ATTATTTTCT CCCATGAAGA
 121 CGGTACGCGA CTGGGCGTGG AGCATCTGGT CGCATTGGGT CACCAGCAAA TCGCGCTGTT
 181 AGCGGGCCCA TTAAGTTCTG TCTCGGCGCG TCTGCGTCTG GCTGGCTGGC ATAAATATCT
 241 CACTCGCAAT CAAATTCAGC CGATAGCGGA ACGGGAAGGC GACTGGAGTG CCATGTCCGG
 301 TTTTCAACAA ACCATGCAAA TGCTGAATGA GGGCATCGTT CCCACTGCGA TGCTGGTTGC
 361 CAACGATCAG ATGGCGCTGG GCGCAATGCG CGCCATTACC GAGTCCGGGC TGCGCGTTGG
 421 TGCGGATATC TCGGTAGTGG GATACGACGA TACCGAAGAC AGCTCATGTT ATATCCCGCC
 481 GTCAACCACC ATCAAACAGG ATTTTCGCCT GCTGGGGCAA ACCAGCGTGG ACCGCTTGCT
 541 GCAACTCTCT CAGGGCCAGG CGGTGAAGGG CAATCAGCTG TTGCCCGTCT CACTGGTGAA
 601 AAGAAAAACC ACCCTGGCAC CCAATACGCA AACCGCCTCT CCCCGCGCGT TGGCCGATTC
 661 ATTAATGCAG CTGGCACGAC AGGTTTCCCG ACTGGAAAGC GGGCAGTGAG CGCAACGCAA
 721 TTAATGTGAG TTAGCGCGAA TTGATCTGGT TTGACAGCTT ATCATCGACT GCACGGTGCA
 781 CCAATGCTTC TGGCGTCAGG CAGCCATCGG AAGCTGTGGT ATGGCTGTGC AGGTCGTAAA
 841 TCACTGCATA ATTCGTGTCG CTCAAGGCGC ACTCCCGTTC TGGATAATGT TTTTTGCGCC
 901 GACATCATAA CGGTTCTGGC AAATATTCTG AAATGAGCTG TTGACAATTA ATCATCCGGT
 961 CCGTATAATC TGTGGAATTG TGAGCGGATA CAATTTCAC ACAGGAAACA GACCATGGGT
1021 CATCATCATC ATCATCACGA TTACGATATC CAACGACCG AAAACCTGTA TTTTCAGGGC
1081 GCCCATATGA GCGATAAAAT TATTCACCTG ACTGACGACA GTTTTGACAC GGATGTACTC
1141 AAAGCGGACG GGGCGATCCT CGTCGATTTC TGGGCAGAGT GGTGCGGTCC GTGCAAAATG
1201 ATCGCCCCGA TTCTGGATGA AATCGCTGAC GAATATCAGG GCAAACTGAC CGTTGCAAAA
1261 CTGAACATCG ATCAAAACCC TGGCACTGCG CCGAAATATG GCATCCGTGG TATCCCGACT
1321 CTGCTGCTGT TCAAAAACGG TGAAGTGGCG GCAACCAAAG TGGGTGCACT GTCTAAAGGT
1381 CAGTTGAAAG AGTTCCTCGA CGCTAACCTG GCCGGTTCTG GTTCTGGTGA TGACGATGAC
1441 AAGGTACCCA TCACAAGTTT GTACAAAAAA GCTGAACGAG AAACGTAAAA TGATATAAAT
1501 ATCAATATAT TAAATTAGAT TTTGCATAAA AAACAGACTA CATAATACTG TAAAACACAA
1561 CATATCCAGT CACTATGGCG GCCGCTAAGT TGGCAGCATC ACCCGACGCA CTTTGCGCCG
1621 AATAAATACC TGTGACGGAA GATCACTTCG CAGAATAAAT AAATCCTGGT GTCCCTGTTG
1681 ATACCGGGAA GCCCTGGGCC AACTTTTGGC GAAAATGAGA CGTTGATCGG CACGTAAGAG
```

FIG.24B

```
1741 GTTCCAACTT TCACCATAAT GAAATAAGAT CACTACCGGG CGTATTTTTT GAGTTATCGA
1801 GATTTTCAGG AGCTAAGGAA GCTAAAATGG AGAAAAAAAT CACTGGATAT ACCACCGTTG
1861 ATATATCCCA ATGGCATCGT AAAGAACATT TTGAGGCATT TCAGTCAGTT GCTCAATGTA
1921 CCTATAACCA GACCGTTCAG CTGGATATTA CGGCCTTTTT AAAGACCGTA AAGAAAAATA
1981 AGCACAAGTT TTATCCGGCC TTTATTCACA TTCTTGCCCG CCTGATGAAT GCTCATCCGG
2041 AATTCCGTAT GGCAATGAAA GACGGTGAGC TGGTGATATG GGATAGTGTT CACCCTTGTT
2101 ACACCGTTTT CCATGAGCAA ACTGAAACGT TTTCATCGCT CTGGAGTGAA TACCACGACG
2161 ATTTCCGGCA GTTTCTACAC ATATATTCGC AAGATGTGGC GTGTTACGGT GAAAACCTGG
2221 CCTATTTCCC TAAAGGGTTT ATTGAGAATA TGTTTTTCGT CTCAGCCAAT CCCTGGGTGA
2281 GTTTCACCAG TTTTGATTTA AACGTGGCCA ATATGGACAA CTTCTTCGCC CCCGTTTTCA
2341 CCATGGGCAA ATATTATACG CAAGGCGACA AGGTGCTGAT GCCGCTGGCG ATTCAGGTTC
2401 ATCATGCCGT CTGTGATGGC TTCCATGTCG CAGAATGCT TAATGAATTA CAACAGTACT
2461 GCGATGAGTG GCAGGGCGGG GCGTAAACGC GTGGATCCGG CTTACTAAAA GCCAGATAAC
2521 AGTATGCGTA TTTGCGCGCT GATTTTTGCG GTATAAGAAT ATATACTGAT ATGTATACCC
2581 GAAGTATGTC AAAAAGAGGT GTGCTATGAA GCAGCGTATT ACAGTGACAG TTGACAGCGA
2641 CAGCTATCAG TTGCTCAAGG CATATATGAT GTCAATATCT CCGGTCTGGT AAGCACAACC
2701 ATGCAGAATG AAGCCCGTCG TCTGCGTGCC GAACGCTGGA AAGCGGAAAA TCAGGAAGGG
2761 ATGGCTGAGG TCGCCCGGTT TATTGAAATG AACGGCTCTT TTGCTGACGA GAACAGGGAC
2821 TGGTGAAATG CAGTTTAAGG TTTACACCTA TAAAAGAGAG AGCCGTTATC GTCTGTTTGT
2881 GGATGTACAG AGTGATATTA TTGACACGCC CGGGCGACGG ATGGTGATCC CCCTGGCCAG
2941 TGCACGTCTG CTGTCAGATA AAGTCTCCCG TGAACTTTAC CCGGTGGTGC ATATCGGGGA
3001 TGAAAGCTGG CGCATGATGA CCACCGATAT GGCCAGTGTG CCGGTCTCCG TTATCGGGGA
3061 AGAAGTGGCT GATCTCAGCC ACCGCGAAAA TGACATCAAA AACGCCATTA ACCTGATGTT
3121 CTGGGGAATA TAAATGTCAG GCTCCCTTAT ACACAGCCAG TCTGCAGGTC GACCATAGTG
3181 ACTGGATATG TTGTGTTTTA CAGTATTATG TAGTCTGTTT TTTATGCAAA ATCTAATTTA
3241 ATATATTGAT ATTTATCA TTTTACGTTT CTCGTTCAGC TTTCTTGTAC AAAGTGGTGA
3301 TGGGGATCCT CTAGAGTCGA CCTGCAGTAA TCGTACAGGG TAGTACAAAT AAAAAAGGCA
3361 CGTCAGATGA CGTGCCTTTT TTCTTGTGAG CAGTAAGCTT GGCTGTTTTG GCGGATGAGA
3421 GAAGATTTTC AGCCTGATAC AGATTAAATC AGAACGCAGA AGCGGTCTGA TAAAACAGAA
3481 TTTGCCTGGC GGCAGTAGCG CGGTGGTCCC ACCTGACCCC ATGCCGAACT CAGAAGTGAA
3541 ACGCCGTAGC GCCGATGGTA GTGTGGGGTC TCCCCATGCG AGAGTAGGGA ACTGCCAGGC
3601 ATCAAATAAA ACGAAAGGCT CAGTCGAAAG ACTGGGCCTT TCGTTTTATC TGTTGTTTGT
3661 CGGTGAACGC TCTCCTGAGT AGGACAAATC CGCCGGGAGC GGATTTGAAC GTTGCGAAGC
3721 AACGGCCCGG AGGGTGGCGG GCAGGACGCC CGCCATAAAC TGCCAGGCAT CAAATTAAGC
3781 AGAAGGCCAT CCTGACGGAT GGCCTTTTTG CGTTTCTACA AACTCTTTTT GTTTATTTTT
3841 CTAAATACAT TCAAATATGT ATCCGCTCAT GAGACAATAA CCCTGATAAA TGCTTCAATA
3901 ATATTGAAAA AGGAAGAGTA TGAGTATTCA ACATTTCCGT GTCGCCCTTA TTCCCTTTTT
3961 TGCGGCATTT TGCCTTCCTG TTTTTGCTCA CCCAGAAACG CTGGTGAAAG TAAAAGATGC
4021 TGAAGATCAG TTGGGTGCAC GAGTGGGTTA CATCGAACTG GATCTCAACA GCGGTAAGAT
4081 CCTTGAGAGT TTTCGCCCCG AAGAACGTTT TCCAATGATG AGCACTTTTA AAGTTCTGCT
4141 ATGTGGCGCG GTATTATCCC GTGTTGACGC CGGGCAAGAG CAACTCGGTC GCCGCATACA
```

FIG.24C

```
4201 CTATTCTCAG AATGACTTGG TTGAGTACTC ACCAGTCACA GAAAAGCATC TTACGGATGG
4261 CATGACAGTA AGAGAATTAT GCAGTGCTGC CATAACCATG AGTGATAACA CTGCGGCCAA
4321 CTTACTTCTG ACAACGATCG GAGGACCGAA GGAGCTAACC GCTTTTTTGC ACAACATGGG
4381 GGATCATGTA ACTCGCCTTG ATCGTTGGGA ACCGGAGCTG AATGAAGCCA TACCAAACGA
4441 CGAGCGTGAC ACCACGATGC CTACAGCAAT GGCAACAACG TTGCGCAAAC TATTAACTGG
4501 CGAACTACTT ACTCTAGCTT CCCGGCAACA ATTAATAGAC TGGATGGAGG CGGATAAAGT
4561 TGCAGGACCA CTTCTGCGCT CGGCCCTTCC GGCTGGCTGG TTTATTGCTG ATAAATCTGG
4621 AGCCGGTGAG CGTGGGTCTC GCGGTATCAT TGCAGCACTG GGGCCAGATG GTAAGCCCTC
4681 CCGTATCGTA GTTATCTACA CGACGGGGAG TCAGGCAACT ATGGATGAAC GAAATAGACA
4741 GATCGCTGAG ATAGGTGCCT CACTGATTAA GCATTGGTAA CTGTCAGACC AAGTTTACTC
4801 ATATATACTT TAGATTGATT TAAAACTTCA TTTTTAATTT AAAAGGATCT AGGTGAAGAT
4861 CCTTTTTGAT AATCTCATGA CCAAAATCCC TTAACGTGAG TTTTCGTTCC ACTGAGCGTC
4921 AGACCCCGTA GAAAAGATCA AAGGATCTTC TTGAGATCCT TTTTTTCTGC GCGTAATCTG
4981 CTGCTTGCAA ACAAAAAAAC CACCGCTACC AGCGGTGGTT TGTTTGCCGG ATCAAGAGCT
5041 ACCAACTCTT TTTCCGAAGG TAACTGGCTT CAGCAGAGCG CAGATACCAA ATACTGTCCT
5101 TCTAGTGTAG CCGTAGTTAG GCCACCACTT CAAGAACTCT GTAGCACCGC CTACATACCT
5161 CGCTCTGCTA ATCCTGTTAC CAGTGGCTGC TGCCAGTGGC GATAAGTCGT GTCTTACCGG
5221 GTTGGACTCA AGACGATAGT TACCGGATAA GGCGCAGCGG TCGGGCTGAA CGGGGGGTTC
5281 GTGCACACAG CCCAGCTTGG AGCGAACGAC CTACACCGAA CTGAGATACC TACAGCGTGA
5341 GCTATGAGAA AGCGCCACGC TTCCCGAAGG GAGAAAGGCG GACAGGTATC CGGTAAGCGG
5401 CAGGGTCGGA ACAGGAGAGC GCACGAGGGA GCTTCCAGGG GGAAACGCCT GGTATCTTTA
5461 TAGTCCTGTC GGGTTTCGCC ACCTCTGACT TGAGCGTCGA TTTTTGTGAT GCTCGTCAGG
5521 GGGGCGGAGC CTATGGAAAA ACGCCAGCAA CGCGGCCTTT TTACGGTTCC TGGCCTTTTG
5581 CTGGCCTTTT GCTCACATGT TCTTTCCTGC GTTATCCCCT GATTCTGTGG ATAACCGTAT
5641 TACCGCCTTT GAGTGAGCTG ATACCGCTCG CCGCAGCCGA ACGACCGAGC GCAGCGAGTC
5701 AGTGAGCGAG GAAGCGGAAG AGCGCCTGAT GCGGTATTTT CTCCTTACGC ATCTGTGCGG
5761 TATTTCACAC CGCATAATTT TGTTAAAATT CGCGTTAAAT TTTTGTTAAA TCAGCTCATT
5821 TTTTAACCAA TAGGCCGAAA TCGGCAAAAT CCCTTATAAA TCAAAAGAAT AGACCGAGAT
5881 AGGGTTGAGT GTTGTTCCAG TTTGGAACAA GAGTCCACTA TTAAAGAACG TGGACTCCAA
5941 CGTCAAAGGG CGAAAAACCG TCTATCAGGG CGATGGCCCA CTACGTGAAC CATCACCCTA
6001 ATCAAGTTTT TTGGGGTCGA GGTGCCGTAA AGCACTAAAT CGGAACCCTA AAGGGAGCCC
6061 CCGATTTAGA GCTTGACGGG GAAAGCCGGC GAACGTGGCG AGAAAGGAAG GGAAGAAAGC
6121 GAAAGGAGCG GGCGCTAGGG CGCTGGCAAG TGTAGCGGTC ACGCTGCGCG TAACCACCAC
6181 ACCCGCCGCG CTTAATGCGC CGCTACAGGG CGCGTCCATT CGCCATTCAG GCTGCTATGG
6241 TGCACTCTCA GTACAATCTG CTCTGATGCC GCATAGTTAA GCCAGTATAC ACTCCGCTAT
6301 CGCTACGTGA CTGGGTCATG GCTGCGCCCC GACACCCGCC AACACCCGCT GACGCGCCCT
6361 GACGGGCTTG TCTGCTCCCG GCATCCGCTT ACAGACAAGC TGTGACCGTC TCCGGGAGCT
6421 GCATGTGTCA GAGGTTTTCA CCGTCATCAC CGAAACGCGC GAGGCAGCAG ATCAATTCGC
6481 GCGCGAAGGC GAAGCGGCAT GCATTTACGT TGACACCATC GAATGGTGCA AAACCTTTCG
6541 CGGTATGGCA TGATAGCGCC CGGAAGAGAG TCAATTCAGG GTGGTGAATG TGAAACCAGT
6601 AACGTTATAC GATGTCGCAG AGTATGCCGG TGTCTCTTAT CAGACCGTTT CCCGCGTGGT
6661 GAACCAGGCC AGCCACGTTT CTGCGAAAAC GCGGGAAAAA GTGGAAGCGG CGATGGCGGA
6721 GCTGAATTAC ATTCCCAACC GCGTGGCACA ACAACTGGCG GGCAAACAGT CGTTGCTGAT
6781 TGGCGTTGCC ACCTCCAGTC TGGCCCTGCA CGCGCCGTCG CAAATTGTCG CGGCGATTAA
6841 ATCTCGCGCC GATCAACTGG GTGCCAGCGT GGTGGTGTCG ATGGTAGAAC GAAGCGGCGT
6901 CGAAGCCTGT AAAGCGGCGG TGCACAATCT TCTCGCGCAA CGCGTCAGTN GGGCTGATCA
6961 TTAA
```

FIG.24D pSPORT '+' (FOR SEQUENCING, PROBES, PHAGEMID)

```
                          -35        lac promoter      -10       lac RNA
  1  agg cac ccc agg c|tt tac a|ct tta tgc ttc cgg ctc g|ta tgt t|gt gtg gaa
     tcc gtg ggg tcc g|aa atg t|ga aat acg aag gcc gag c|at aca a|ca cac ctt "reverse" sequencing primers
     ⎴_____⎴
                                                  ⎴── α — peptide
 52  ttg tga gcg gat aac aat ttc aca cag gaa aca gct atg acc atg att acg
     aac act cgc cta ttg tta aag tgt gtc ctt tgt cga tac tgg tac taa tgc T7 Promoter    ⎴─T7 RNA          Pst     Kpn
103  cca agc tc|t aat acg act cac tat agg|gaa agc tgg tac gcc tgc a|gg tac|
     ggt tcg ag|a tta tgc tga gtg ata tcc|ctt tcg acc atg cgg|acg t|cc atg
                                                                 ↓      ↓

EcoRI    Sma   Sal                         Int    attR1
154  cgg tcc gg|a att ccc|ggg|tcg acg|atc |aca agt tt̸g̸ t̸a̸c̸ a̸a̸a̸ a̸a̸g̸ c̸t̸ g̸a̸a̸
     gcc agg cct taa|ggg|ccc agc t|gc tag |tgt tca aac atg ttt t̸t̸c̸ g̸a̸c̸ c̸t̸t̸
                  ↓       ↓      ↓

↓ Gene

Int      attR2           Spe
1990  t̸t̸t̸ a̸c̸g̸ t̸t̸t̸ c̸t̸c̸ g̸t̸t̸ c̸a̸g̸ c̸t̸t̸ |ct tgt aca aag tgg t|ga tca |cta gtc ggc
      a̸a̸a̸ t̸g̸c̸ a̸a̸a̸ g̸a̸g̸ c̸a̸a̸ g̸t̸c̸ g̸a̸a̸ ga̸ a̸c̸a̸ t̸g|t ttc acc act agt gat c|ag ccg Not   Xba   Bam   HindIII   Mlu      Sph
2041  |ggc cgc t|ct aga |gga tcc a|ag ctt|acg t|ac gcg tgc atg|cga cgt cat agc
       ccg g|cg aga tc|t cct agg |ttc ga|a tgc atg cgc|acg tac gct gca gta tcg
         ↓         ↓         ↓         ↓      ↓    ↓

SP6 Promoter
2092  tct t|ct ata gtg tca cct aaa t|tc att tca ctg gcc gtc gtt tta caa cgt
      aga a|ga tat cac agt gga ttt a|ag taa agt gac cgg cag caa aat gtt gca
      ⎴_____
         SP6 RNA                          "forward sequencing....

2143  cgt gac tgg gaa aac cct ggc gtt acc caa ctt aat cgc ctt gca gca cat
      gca ctg acc ctt ttg gga ccg caa tgg gtt gaa tta gcg gaa cgt cgt gta
                                ⎴_____
      ...primers
```

FIG.25A pDEST5 pDEST5 5957 bp

| Location (Base Nos.) | Gene Encoded |
|---|---|
| 305..181 | attR1 |
| 555..1214 | CmR |
| 1334..1418 | inactivated ccdA |
| 1556..1861 | ccdB |
| 1902..2026 | attR2 |
| 2278..2733 | f1 (f1 intergenic region) |
| 2865..3722 | ampR |
| 5378..5538 | ori |
| 4756..5922 | lacI |

```
   1 AGGCACCCCA GGCTTTACAC TTTATGCTTC CGGCTCGTAT GTTGTGTGGA ATTGTGAGCG
  61 GATAACAATT TCACACAGGA AACAGCTATG ACCATGATTA CGCCAAGCTC TAATACGACT
 121 CACTATAGGG AAAGCTGGTA CGCCTGCAGG TACCGGTCCG GAATTCCCGG GTCGACGATC
 181 ACAAGTTTGT ACAAAAAAGC TGAACGAGAA ACGTAAAATG ATATAAATAT CAATATATTA
 241 AATTAGATTT TGCATAAAAA ACAGACTACA TAATACTGTA AAACACAACA TATCCAGTCA
 301 CTATGGCGGC CGCTAAGTTG GCAGCATCAC CCGACGCACT TTGCGCCGAA TAAATACCTG
 361 TGACGGAAGA TCACTTCGCA GAATAAATAA ATCCTGGTGT CCCTGTTGAT ACCGGGAAGC
 421 CCTGGGCCAA CTTTTGGCGA AAATGAGACG TTGATCGGCA CGTAAGAGGT TCCAACTTTC
 481 ACCATAATGA AATAAGATCA CTACCGGGCG TATTTTTTGA GTTATCGAGA TTTTCAGGAG
 541 CTAAGGAAGC TAAAATGGAG AAAAAAATCA CTGGATATAC CACCGTTGAT ATATCCCAAT
 601 GGCATCGTAA AGAACATTTT GAGGCATTTC AGTCAGTTGC TCAATGTACC TATAACCAGA
 661 CCGTTCAGCT GGATATTACG GCCTTTTTAA AGACCGTAAA GAAAAATAAG CACAAGTTTT
 721 ATCCGGCCTT TATTCACATT CTTGCCCGCC TGATGAATGC TCATCCGGAA TTCCGTATGG
 781 CAATGAAAGA CGGTGAGCTG GTGATATGGG ATAGTGTTCA CCCTTGTTAC ACCGTTTTCC
 841 ATGAGCAAAC TGAAACGTTT TCATCGCTCT GGAGTGAATA CCACGACGAT TTCCGGCAGT
 901 TTCTACACAT ATATTCGCAA GATGTGGCGT GTTACGGTGA AAACCTGGCC TATTTCCCTA
 961 AAGGGTTTAT TGAGAATATG TTTTTCGTCT CAGCCAATCC CTGGGTGAGT TTCACCAGTT
1021 TTGATTTAAA CGTGGCCAAT ATGGACAACT TCTTCGCCCC CGTTTTCACC ATGGGCAAAT
1081 ATTATACGCA AGGCGACAAG GTGCTGATGC CGCTGGCGAT TCAGGTTCAT CATGCCGTCT
1141 GTGATGGCTT CCATGTCGGC AGAATGCTTA ATGAATTACA ACAGTACTGC GATGAGTGGC
1201 AGGGCGGGGC GTAAACGCGT GGATCCGGCT TACTAAAAGC CAGATAACAG TATGCGTATT
1261 TGCGCGCTGA TTTTTGCGGT ATAAGAATAT ATACTGATAT GTATACCCGA AGTATGTCAA
1321 AAAGAGGTGT GCTATGAAGC AGCGTATTAC AGTGACAGTT GACAGCGACA GCTATCAGTT
1381 GCTCAAGGCA TATATGATGT CAATATCTCC GGTCTGGTAA GCACAACCAT GCAGAATGAA
1441 GCCCGTCGTC TGCGTGCCGA ACGCTGGAAA GCGGAAAATC AGGAAGGGAT GGCTGAGGTC
1501 GCCCGGTTTA TTGAAATGAA CGGCTCTTTT GCTGACGAGA ACAGGGACTG GTGAAATGCA
1561 GTTTAAGGTT TACACCTATA AAAGAGAGAG CCGTTATCGT CTGTTTGTGG ATGTACAGAG
1621 TGATATTATT GACACGCCCG GGCGACGGAT GGTGATCCCC CTGGCCAGTG CACGTCTGCT
1681 GTCAGATAAA GTCTCCCGTG AACTTTACCC GGTGGTGCAT ATCGGGGATG AAAGCTGGCG
1741 CATGATGACC ACCGATATGG CCAGTGTGCC GGTCTCCGTT ATCGGGGAAG AAGTGGCTGA
```

FIG.25C

```
1801 TCTCAGCCAC CGCGAAAATG ACATCAAAAA CGCCATTAAC CTGATGTTCT GGGGAATATA
1861 AATGTCAGGC TCCCTTATAC ACAGCCAGTC TGCAGGTCGA CCATAGTGAC TGGATATGTT
1921 GTGTTTTACA GTATTATGTA GTCTGTTTTT TATGCAAAAT CTAATTTAAT ATATTGATAT
1981 TTATATCATT TTACGTTTCT CGTTCAGCTT TCTTGTACAA AGTGGTGATC ACTAGTCGGC
2041 GGCCGCTCTA GAGGATCCAA GCTTACGTAC GCGTGCATGC GACGTCATAG CTCTTCTATA
2101 GTGTCACCTA AATTCAATTC ACTGGCCGTC GTTTTACAAC GTCGTGACTG GGAAAACCCT
2161 GGCGTTACCC AACTTAATCG CCTTGCAGCA CATCCCCCTT TCGCCAGCTG GCGTAATAGC
2221 GAAGAGGCCC GCACCGATCG CCCTTCCCAA CAGTTGCGCA GCCTGAATGG CGAATGGACG
2281 CGCCCTGTAG CGGCGCATTA AGCGCGGCGG GTGTGGTGGT TACGCGCAGC GTGACCGCTA
2341 CACTTGCCAG CGCCCTAGCG CCCGCTCCTT TCGCTTTCTT CCCTTCCTTT CTCGCCACGT
2401 TCGCCGGCTT TCCCCGTCAA GCTCTAAATC GGGGGCTCCC TTTAGGGTTC CGATTTAGTG
2461 CTTTACGGCA CCTCGACCCC AAAAAACTTG ATTAGGGTGA TGGTTCACGT AGTGGGCCAT
2521 CGCCCTGATA GACGGTTTTT CGCCCTTTGA CGTTGGAGTC CACGTTCTTT AATAGTGGAC
2581 TCTTGTTCCA AACTGGAACA ACACTCAACC CTATCTCGGT CTATTCTTTT GATTTATAAG
2641 GGATTTTGCC GATTTCGGCC TATTGGTTAA AAAATGAGCT GATTTAACAA AAATTTAACG
2701 CGAATTTTAA CAAAATATTA ACGTTACAA TTTCAGGTGG CACTTTTCGG GGAAATGTGC
2761 GCGGAACCCC TATTTGTTTA TTTTTCTAAA TACATTCAAA TATGTATCCG CTCATGAGAC
2821 AATAACCCTG ATAAATGCTT CAATAATATT GAAAAAGGAA GAGTATGAGT ATTCAACATT
2881 TCCGTGTCGC CCTTATTCCC TTTTTTGCGG CATTTTGCCT TCCTGTTTTT GCTCACCCAG
2941 AAACGCTGGT GAAAGTAAAA GATGCTGAAG ATCAGTTGGG TGCACGAGTG GGTTACATCG
3001 AACTGGATCT CAACAGCGGT AAGATCCTTG AGAGTTTTCG CCCCGAAGAA CGTTTTCCAA
3061 TGATGAGCAC TTTTAAAGTT CTGCTATGTG GCGCGGTATT ATCCCGTATT GACGCCGGGC
3121 AAGAGCAACT CGGTCGCCGC ATACACTATT CTCAGAATGA CTTGGTTGAG TACTCACCAG
3181 TCACAGAAAA GCATCTTACG GATGGCATGA CAGTAAGAGA ATTATGCAGT GCTGCCATAA
3241 CCATGAGTGA TAACACTGCG GCCAACTTAC TTCTGACAAC GATCGGAGGA CCGAAGGAGC
3301 TAACCGCTTT TTTGCACAAC ATGGGGGATC ATGTAACTCG CCTTGATCGT TGGGAACCGG
3361 AGCTGAATGA AGCCATACCA AACGACGAGC GTGACACCAC GATGCCTGTA GCAATGGCAA
3421 CAACGTTGCG CAAACTATTA ACTGGCGAAC TACTTACTCT AGCTTCCCGG CAACAATTAA
3481 TAGACTGGAT GGAGGCGGAT AAAGTTGCAG GACCACTTCT GCGCTCGGCC CTTCCGGCTG
3541 GCTGGTTTAT TGCTGATAAA TCTGGAGCCG GTGAGCGTGG GTCTCGCGGT ATCATTGCAG
3601 CACTGGGGCC AGATGGTAAG CCCTCCCGTA TCGTAGTTAT CTACACGACG GGGAGTCAGG
3661 CAACTATGGA TGAACGAAAT AGACAGATCG CTGAGATAGG TGCCTCACTG ATTAAGCATT
3721 GGTAACTGTC AGACCAAGTT TACTCATATA TACTTTAGAT TGATTTAAAA CTTCATTTTT
3781 AATTTAAAAG GATCTAGGTG AAGATCCTTT TTGATAATCT CATGACCAAA ATCCCTTAAC
3841 GTGAGTTTTC GTTCCACTGA GCGTCAGACC CCGTAGAAAA GATCAAAGGA TCTTCTTGAG
3901 ATCCTTTTTT TCTGCGCGTA ATCTGCTGCT TGCAAACAAA AAAACCACCG CTACCAGCGG
3961 TGGTTTGTTT GCCGGATCAA GAGCTACCAA CTCTTTTTCC GAAGGTAACT GGCTTCAGCA
4021 GAGCGCAGAT ACCAAATACT GTCCTTCTAG TGTAGCCGTA GTTAGGCCAC CACTTCAAGA
4081 ACTCTGTAGC ACCGCCTACA TACCTCGCTC TGCTAATCCT GTTACCAGTG GCTGCTGCCA
4141 GTGGCGATAA GTCGTGTCTT ACCGGGTTGG ACTCAAGACG ATAGTTACCG GATAAGGCGC
4201 AGCGGTCGGG CTGAACGGGG GGTTCGTGCA CACAGCCCAG CTTGGAGCGA ACGACCTACA
```

FIG.25D

```
4261 CCGAACTGAG ATACCTACAG CGTGAGCATT GAGAAAGCGC CACGCTTCCC GAAGGGAGAA
4321 AGGCGGACAG GTATCCGGTA AGCGGCAGGG TCGGAACAGG AGAGCGCACG AGGGAGCTTC
4381 CAGGGGGAAA CGCCTGGTAT CTTTATAGTC CTGTCGGGTT TCGCCACCTC TGACTTGAGC
4441 GTCGATTTTT GTGATGCTCG TCAGGGGGGC GGAGCCTATG GAAAAACGCC AGCAACGCGG
4501 CCTTTTTACG GTTCCTGGCC TTTTGCTGGC CTTTTGCTCA CATGTTCTTT CCTGCGTTAT
4561 CCCCTGATTC TGTGGATAAC CGTATTACCG CCTTTGAGTG AGCTGATACC GCTCGCCGCA
4621 GCCGAACGAC CGAGCGCAGC GAGTCAGTGA GCGAGGAAGC GGAAGAGCGC CCAATACGCA
4681 AACCGCCTCT CCCCGCGCGT TGGCCGATTC ATTAATGCAG AGCTTGCAAT TCGCGCGCGA
4741 AGGCGAAGCG GCATTTACGT TGACACCATC GAATGGCGCA AAACCTTTCG CGGTATGGCA
4801 TGATAGCGCC CGGAAGAGAG TCAATTCAGG GTGGTGAATG TGAAACCAGT AACGTTATAC
4861 GATGTCGCAG AGTATGCCGG TGTCTCTTAT CAGACCGTTT CCCGCGTGGT GAACCAGGCC
4921 AGCCACGTTT CTGCGAAAAC GCGGGAAAAA GTGGAAGCGG CGATGGCGGA GCTGAATTAC
4981 ATTCCCAACC GCGTGGCACA ACAACTGGCG GGCAAACAGT CGTTGCTGAT TGGCGTTGCC
5041 ACCTCCAGTC TGGCCCTGCA CGCGCCGTCG CAAATTGTCG CGGCGATTAA ATCTCGCGCC
5101 GATCAACTGG GTGCCAGCGT GGTGGTGTCG ATGGTAGAAC GAAGCGGCGT CGAAGCCTGT
5161 AAAGCGGCGG TGCACAATCT TCTCGCGCAA CGGGTCAGTG GCTGATCAT TAACTATCCG
5221 CTGGATGACC AGGATGCCAT TGCTGTGGAA GCTGCCTGCA CTAATGTTCC GGCGTTATTT
5281 CTTGATGTCT CTGACCAGAC ACCCATCAAC AGTATTATTT TCTCCCATGA AGACGGTACG
5341 CGACTGGGCG TGGAGCATCT GGTCGCATTG GGTCACCAGC AAATCGCGCT GTTAGCGGGC
5401 CCATTAAGTT CTGTCTCGGC GCGTCTGCGT CTGGCTGGCT GGCATAAATA TCTCACTCGC
5461 AATCAAATTC AGCCGATAGC GGAACGGGAA GGCGACTGGA GTGCCATGTC CGGTTTTCAA
5521 CAAACCATGC AAATGCTGAA TGAGGGCATC GTTCCCACTG CGATGCTGGT TGCCAACGAT
5581 CAGATGGCGC TGGGCGCAAT GCGCGCCATT ACCGAGTCCG GCTGCGCGT TGGTGCGGAT
5641 ATCTCGGTAG TGGGATACGA CGATACCGAA GACAGCTCAT GTTATATCCC GCCGTCAACC
5701 ACCATCAAAC AGGATTTTCG CCTGCTGGGG CAAACCAGCG TGGACCGCTT GCTGCAACTC
5761 TCTCAGGGCC AGGCGGTGAA GGGCAATCAG CTGTTGCCCG TCTCACTGGT GAAAAGAAAA
5821 ACCACCCTGG CGCCCAATAC GCAAACCGCC TCTCCCCGCG CGTTGGCCGA TTCATTAATG
5881 CAGCTGGCAC GACAGGTTTC CGACTGGAAA GCGGGCAGT GAGCGCAACG CAATTAATGT
5941 GAGTTAGCTC ACTCATT
```

FIG.25E pSPORT "-" (OPPOSITE STRAND)

"FORWARD" SEQUENCING PRIMERS 1   taa cgc cag ggt ttt ccc agt cac gac gtt gta aaa cga cgg cca gtg aat
    att gcg gtc cca aaa ggg tca gtg ctg caa cat ttt gct gcc ggt cac tta SP6 PROMOTER                                     Sph Mlu
52  tga att tag gtg aca cta tag aag agc tat gac gtc gca tgc acg cgt acg
    act taa atc cac tgt gat atc ttc tcg ata ctg cag cgt acg tgc gca tgc Hind 3   Bam    Xba    Not      Spe         attR1   Int
103 taa gct tgg atc ctc tag agc ggc cgc cga cta gtg atc aca agt ttg tac
    att cga acc tag gag atc tcg ccg gcg gct gat cac tag tgt tca aac atg 154 (hatched/gene region)

↓ GENE

Int attR2
1939 (hatched region) ... tct tgt aca aag tgg tga
     (hatched region) ... aga aca tgt ttc acc act Sal    Sma EcoRI           Kpn    Pst
1990 tcg tcg acc cgg gaa ttc cgg acc ggt acc tgc agg cgt acc agc ttt ccc
     agc agc tgg gcc ctt aag gcc tgg cca tgg acg tcc gca tgg tcg aaa ggg
                                                                    T7 RNA 2041 tat agt gag tcg tat tag agc ttg gcg taa tca tgg tca tag ctg ttt cct
     ata tca ctc agc ata atc tcg aac cgc att agt acc agt atc gac aaa gga
          T7 PROMOTER                   α-peptide
                                                              "REVERSE"...
                                                -10           lac PROMOTER
2092 gtg tga aat tgt tat ccg ctc aca att cca cac aac ata cga gcc gga agc
     cac act tta aca ata ggc gag tgt taa ggt gtg ttg tat gct cgg cct tcg ... SEQUENCING PRIMERS        lac RNA -35
2143 ata aag tgt aaa gcc tgg ggt gcc taa tga gtg agc taa ctc aca tta att
     tat ttc aca ttt cgg acc cca cgg att act cac tcg att gag tgt aat taa

FIG.26A pDEST6 pDEST6 5957 bp

| Location (Base Nos.) | Gene Encoded |
|---|---|
| 266..142 | attR1 |
| 516..1175 | CmR |
| 1295..1379 | inactivated ccdA |
| 1517..1822 | ccdB |
| 1863..1987 | attR2 |
| 2203..3369 | lacI |
| 4403..5260 | ampR |
| 5392..5847 | f1 (f1 intergenic region) |

```
   1 TAACGCCAGG GTTTTCCCAG TCACGACGTT GTAAAACGAC GGCCAGTGAA TTGAATTTAG
  61 GTGACACTAT AGAAGAGCTA TGACGTCGCA TGCACGCGTA CGTAAGCTTG GATCCTCTAG
 121 AGCGGCCGCC GACTAGTGAT CACAAGTTTG TACAAAAAAG CTGAACGAGA AACGTAAAAT
 181 GATATAAATA TCAATATATT AAATTAGATT TTGCATAAAA AACAGACTAC ATAATACTGT
 241 AAAACACAAC ATATCCAGTC ACTATGGCGG CCGCTAAGTT GGCAGCATCA CCCGACGCAC
 301 TTTGCGCCGA ATAAATACCT GTGACGGAAG ATCACTTCGC AGAATAAATA AATCCTGGTG
 361 TCCCTGTTGA TACCGGGAAG CCCTGGGCCA ACTTTTGGCG AAAATGAGAC GTTGATCGGC
 421 ACGTAAGAGG TTCCAACTTT CACCATAATG AAATAAGATC ACTACCGGGC GTATTTTTTG
 481 AGTTATCGAG ATTTTCAGGA GCTAAGGAAG CTAAAATGGA GAAAAAAATC ACTGGATATA
 541 CCACCGTTGA TATATCCCAA TGGCATCGTA AAGAACATTT TGAGGCATTT CAGTCAGTTG
 601 CTCAATGTAC CTATAACCAG ACCGTTCAGC TGGATATTAC GGCCTTTTTA AAGACCGTAA
 661 AGAAAAATAA GCACAAGTTT TATCCGGCCT TTATTCACAT TCTTGCCCGC CTGATGAATG
 721 CTCATCCGGA ATTCCGTATG GCAATGAAAG ACGGTGAGCT GGTGATATGG GATAGTGTTC
 781 ACCCTTGTTA CACCGTTTTC CATGAGCAAA CTGAAACGTT TTCATCGCTC TGGAGTGAAT
 841 ACCACGACGA TTTCCGGCAG TTTCTACACA TATATTCGCA AGATGTGGCG TGTTACGGTG
 901 AAAACCTGGC CTATTTCCCT AAAGGGTTTA TTGAGAATAT GTTTTTCGTC TCAGCCAATC
 961 CCTGGGTGAG TTTCACCAGT TTTGATTTAA ACGTGGCCAA TATGGACAAC TTCTTCGCCC
1021 CCGTTTTCAC CATGGGCAAA TATTATACGC AAGGCGACAA GGTGCTGATG CCGCTGGCGA
1081 TTCAGGTTCA TCATGCCGTC TGTGATGGCT TCCATGTCGG CAGAATGCTT AATGAATTAC
1141 AACAGTACTG CGATGAGTGG CAGGGCGGGG CGTAAACGCG TGGATCCGGC TTACTAAAAG
1201 CCAGATAACA GTATGCGTAT TTGCGCGCTG ATTTTTGCGG TATAAGAATA TATACTGATA
1261 TGTATACCCG AAGTATGTCA AAAAGAGGTG TGCTATGAAG CAGCGTATTA CAGTGACAGT
1321 TGACAGCGAC AGCTATCAGT TGCTCAAGGC ATATATGATG TCAATATCTC CGGTCTGGTA
1381 AGCACAACCA TGCAGAATGA AGCCCGTCGT CTGCGTGCCG AACGCTGGAA AGCGGAAAAT
1441 CAGGAAGGGA TGGCTGAGGT CGCCCGGTTT ATTGAAATGA ACGGCTCTTT TGCTGACGAG
1501 AACAGGGACT GGTGAAATGC AGTTTAAGGT TTACACCTAT AAAAGAGAGA GCCGTTATCG
1561 TCTGTTTGTG GATGTACAGA GTGATATTAT TGACACGCCC GGGCGACGGA TGGTGATCCC
1621 CCTGGCCAGT GCACGTCTGC TGTCAGATAA AGTCTCCCGT GAACTTTACC CGGTGGTGCA
1681 TATCGGGGAT GAAAGCTGGC GCATGATGAC CACCGATATG GCCAGTGTGC CGGTCTCCGT
1741 TATCGGGGAA GAAGTGGCTG ATCTCAGCCA CCGCGAAAAT GACATCAAAA ACGCCATTAA
1801 CCTGATGTTC TGGGGAATAT AAATGTCAGG CTCCCTTATA CACAGCCAGT CTGCAGGTCG
```

FIG.26C

```
1861 ACCATAGTGA CTGGATATGT TGTGTTTTAC AGTATTATGT AGTCTGTTTT TTATGCAAAA
1921 TCTAATTTAA TATATTGATA TTTATATCAT TTTACGTTTC TCGTTCAGCT TTCTTGTACA
1981 AAGTGGTGAT CGTCGACCCG GGAATTCCGG ACCGGTACCT GCAGGCGTAC CAGCTTTCCC
2041 TATAGTGAGT CGTATTAGAG CTTGGCGTAA TCATGGTCAT AGCTGTTTCC TGTGTGAAAT
2101 TGTTATCCGC TCACAATTCC ACACAACATA CGAGCCGGAA GCATAAAGTG TAAAGCCTGG
2161 GGTGCCTAAT GAGTGAGCTA ACTCACATTA ATTGCGTTGC GCTCACTGCC CGCTTTCCAG
2221 TCGGGAAACC TGTCGTGCCA GCTGCATTAA TGAATCGGCC AACGCGCGGG GAGAGGCGGT
2281 TTGCGTATTG GGCGCCAGGG TGGTTTTTCT TTTCACCAGT GAGACGGGCA ACAGCTGATT
2341 GCCCTTCACC GCCTGGCCCT GAGAGAGTTG CAGCAAGCGG TCCACGCTGG TTTGCCCCAG
2401 CAGGCGAAAA TCCTGTTTGA TGGTGGTTGA CGGCGGGATA TAACATGAGC TGTCTTCGGT
2461 ATCGTCGTAT CCCACTACCG AGATATCCGC ACCAACGCGC AGCCCGGACT CGGTAATGGC
2521 GCGCATTGCG CCCAGCGCCA TCTGATCGTT GGCAACCAGC ATCGCAGTGG GAACGATGCC
2581 CTCATTCAGC ATTTGCATGG TTTGTTGAAA ACCGGACATG GCACTCCAGT CGCCTTCCCG
2641 TTCCGCTATC GGCTGAATTT GATTGCGAGT GAGATATTTA TGCCAGCCAG CCAGACGCAG
2701 ACGCGCCGAG ACAGAACTTA ATGGGCCCGC TAACAGCGCG ATTTGCTGGT GACCCAATGC
2761 GACCAGATGC TCCACGCCCA GTCGCGTACC GTCTTCATGG GAGAAAATAA TACTGTTGAT
2821 GGGTGTCTGG TCAGAGACAT CAAGAAATAA CGCCGGAACA TTAGTGCAGG CAGCTTCCAC
2881 AGCAATGGCA TCCTGGTCAT CCAGCGGATA GTTAATGATC AGCCCACTGA CCCGTTGCGC
2941 GAGAAGATTG TGCACCGCCG CTTTACAGGC TTCGACGCCG CTTCGTTCTA CCATCGACAC
3001 CACCACGCTG GCACCCAGTT GATCGGCGCG AGATTTAATC GCCGCGACAA TTTGCGACGG
3061 CGCGTGCAGG GCCAGACTGG AGGTGGCAAC GCCAATCAGC AACGACTGTT TGCCCGCCAG
3121 TTGTTGTGCC ACGCGGTTGG GAATGTAATT CAGCTCCGCC ATCGCCGCTT CCACTTTTTC
3181 CCGCGTTTTC GCAGAAACGT GGCTGGCCTG GTTCACCACG CGGGAAACGG TCTGATAAGA
3241 GACACCGGCA TACTCTGCGA CATCGTATAA CGTTACTGGT TTCACATTCA CCACCCTGAA
3301 TTGACTCTCT TCCGGGCGCT ATCATGCCAT ACCGCGAAAG GTTTTGCGCC ATTCGATGGT
3361 GTCAACGTAA ATGCCGCTTC GCCTTCGCGC GCGAATTGCA AGCTCTGCAT TAATGAATCG
3421 GCCAACGCGC GGGGAGAGGC GGTTTGCGTA TTGGGCGCTC TTCCGCTTCC TCGCTCACTG
3481 ACTCGCTGCG CTCGGTCGTT CGGCTGCGGC GAGCGGTATC AGCTCACTCA AAGGCGGTAA
3541 TACGGTTATC CACAGAATCA GGGGATAACG CAGGAAAGAA CATGTGAGCA AAAGGCCAGC
3601 AAAAGGCCAG GAACCGTAAA AAGGCCGCGT TGCTGGCGTT TTTCCATAGG CTCCGCCCCC
3661 CTGACGAGCA TCACAAAAAT CGACGCTCAA GTCAGAGGTG GCGAAACCCG ACAGGACTAT
3721 AAAGATACCA GGCGTTTCCC CCTGGAAGCT CCCTCGTGCG CTCTCCTGTT CCGACCCTGC
3781 CGCTTACCGG ATACCTGTCC GCCTTTCTCC CTTCGGGAAG CGTGGCGCTT TCTCAATGCT
3841 CACGCTGTAG GTATCTCAGT TCGGTGTAGG TCGTTCGCTC CAAGCTGGGC TGTGTGCACG
3901 AACCCCCCGT TCAGCCCGAC CGCTGCGCCT TATCCGGTAA CTATCGTCTT GAGTCCAACC
3961 CGGTAAGACA CGACTTATCG CCACTGGCAG CAGCCACTGG TAACAGGATT AGCAGAGCGA
4021 GGTATGTAGG CGGTGCTACA GAGTTCTTGA AGTGGTGGCC TAACTACGGC TACACTAGAA
4081 GGACAGTATT TGGTATCTGC GCTCTGCTGA AGCCAGTTAC CTTCGGAAAA AGAGTTGGTA
4141 GCTCTTGATC CGGCAAACAA ACCACCGCTG GTAGCGGTGG TTTTTTTGTT TGCAAGCAGC
4201 AGATTACGCG CAGAAAAAAA GGATCTCAAG AAGATCCTTT GATCTTTTCT ACGGGGTCTG
4261 ACGCTCAGTG GAACGAAAAC TCACGTTAAG GGATTTTGGT CATGAGATTA TCAAAAAGGA
```

FIG.26D

```
4321 TCTTCACCTA GATCCTTTTA AATTAAAAAT GAAGTTTTAA ATCAATCTAA AGTATATATG
4381 AGTAAACTTG GTCTGACAGT TACCAATGCT TAATCAGTGA GGCACCTATC TCAGCGATCT
4441 GTCTATTTCG TTCATCCATA GTTGCCTGAC TCCCCGTCGT GTAGATAACT ACGATACGGG
4501 AGGGCTTACC ATCTGGCCCC AGTGCTGCAA TGATACCGCG AGACCCACGC TCACCGGCTC
4561 CAGATTTATC AGCAATAAAC CAGCCAGCCG GAAGGGCCGA GCGCAGAAGT GGTCCTGCAA
4621 CTTTATCCGC CTCCATCCAG TCTATTAATT GTTGCCGGGA AGCTAGAGTA AGTAGTTCGC
4681 CAGTTAATAG TTTGCGCAAC GTTGTTGCCA TTGCTACAGG CATCGTGGTG TCACGCTCGT
4741 CGTTTGGTAT GGCTTCATTC AGCTCCGGTT CCCAACGATC AAGGCGAGTT ACATGATCCC
4801 CCATGTTGTG CAAAAAAGCG GTTAGCTCCT TCGGTCCTCC GATCGTTGTC AGAAGTAAGT
4861 TGGCCGCAGT GTTATCACTC ATGGTTATGG CAGCACTGCA TAATTCTCTT ACTGTCATGC
4921 CATCCGTAAG ATGCTTTTCT GTGACTGGTG AGTACTCAAC CAAGTCATTC TGAGAATAGT
4981 GTATGCGGCG ACCGAGTTGC TCTTGCCCGG CGTCAATACG GGATAATACC GCGCCACATA
5041 GCAGAACTTT AAAAGTGCTC ATCATTGGAA AACGTTCTTC GGGGCGAAAA CTCTCAAGGA
5101 TCTTACCGCT GTTGAGATCC AGTTCGATGT AACCCACTCG TGCACCCAAC TGATCTTCAG
5161 CATCTTTTAC TTTCACCAGC GTTTCTGGGT GAGCAAAAAC AGGAAGGCAA AATGCCGCAA
5221 AAAAGGGAAT AAGGGCGACA CGGAAATGTT GAATACTCAT ACTCTTCCTT TTTCAATATT
5281 ATTGAAGCAT TTATCAGGGT TATTGTCTCA TGAGCGGATA CATATTTGAA TGTATTTAGA
5341 AAAATAAACA AATAGGGGTT CCGCGCACAT TTCCCCGAAA AGTGCCACCT GAAATTGTAA
5401 ACGTTAATAT TTTGTTAAAA TTCGCGTTAA ATTTTTGTTA AATCAGCTCA TTTTTTAACC
5461 AATAGGCCGA AATCGGCAAA ATCCCTTATA AATCAAAAGA ATAGACCGAG ATAGGGTTGA
5521 GTGTTGTTCC AGTTTGGAAC AAGAGTCCAC TATTAAAGAA CGTGGACTCC AACGTCAAAG
5581 GGCGAAAAAC CGTCTATCAG GGCGATGGCC CACTACGTGA ACCATCACCC TAATCAAGTT
5641 TTTTGGGGTC GAGGTGCCGT AAAGCACTAA ATCGGAACCC TAAAGGGAGC CCCCGATTTA
5701 GAGCTTGACG GGGAAAGCCG GCGAACGTGG CGAGAAAGGA AGGGAAGAAA GCGAAAGGAG
5761 CGGGCGCTAG GGCGCTGGCA AGTGTAGCGG TCACGCTGCG CGTAACCACC ACACCCGCCG
5821 CGCTTAATGC GCCGCTACAG GGCGCGTCCA TTCGCCATTC AGGCTGCGCA ACTGTTGGGA
5881 AGGGCGATCG GTGCGGGCCT CTTCGCTATT ACGCCAGCTG GCGAAAGGGG GATGTGCTGC
5941 AAGGCGATTA AGTTGGG
```

FIG.26E pDEST7 6025 bp (rotated to position 2800)

| Location (Base Nos.) | Gene Encoded |
|---|---|
| 67..589 | CMV promoter |
| 906..782 | attR1 |
| 1015..1674 | CmR |
| 1794..1878 | inactivated ccdA |
| 2016..2321 | ccdB |
| 2362..2486 | attR2 |
| 2671..3033 | small t & polyA |
| 3227..3502 | f1 |
| 3962..4822 | ampR |
| 5022..5661 | ori |

```
   1 ATTATCATGA CATTAACCTA TAAAAATAGG CGTAGTACGA GGCCCTTTCA CTCATTAGAT
  61 GCATGTCGTT ACATAACTTA CGGTAAATGG CCCGCCTGGC TGACCGCCCA ACGACCCCCG
 121 CCCATTGACG TCAATAATGA CGTATGTTCC CATAGTAACG CCAATAGGGA CTTTCCATTG
 181 ACGTCAATGG GTGGAGTATT TACGGTAAAC TGCCCACTTG GCAGTACATC AAGTGTATCA
 241 TATGCCAAGT ACGCCCCTA TTGACGTCAA TGACGGTAAA TGGCCCGCCT GGCATTATGC
 301 CCAGTACATG ACCTTATGGG ACTTTCCTAC TTGGCAGTAC ATCTACGTAT TAGTCATCGC
 361 TATTACCATG GTGATGCGGT TTTGGCAGTA CATCAATGGG CGTGGATAGC GGTTTGACTC
 421 ACGGGGATTT CCAAGTCTCC ACCCCATTGA CGTCAATGGG AGTTTGTTTT GGCACCAAAA
 481 TCAACGGGAC TTTCCAAAAT GTCGTAACAA CTCCGCCCCA TTGACGCAAA TGGGCGGTAG
 541 GCGTGTACGG TGGGAGGTCT ATATAAGCAG AGCTCGTTTA GTGAACCGTC AGATCGCCTG
 601 GAGACGCCAT CCACGCTGTT TTGACCTCCA TAGAAGACAC CGGGACCGAT CCAGCCTCCG
 661 GACTCTAGCC TAGGCCGCGG AGCGGATAAC AATTTCACAC AGGAAACAGC TATGACCATT
 721 AGGCCTTTGC AAAAAGCTAT TTAGGTGACA CTATAGAAGG TACGCCTGCA GGTACCGGAT
 781 CACAAGTTTG TACAAAAAAG CTGAACGAGA AACGTAAAAT GATATAAATA TCAATATATT
 841 AAATTAGATT TTGCATAAAA AACAGACTAC ATAATACTGT AAAACACAAC ATATCCAGTC
 901 ACTATGGCGG CCGCATTAGG CACCCCAGGC TTTACACTTT ATGCTTCCGG CTCGTATAAT
 961 GTGTGGATTT TGAGTTAGGA TCCGTCGAGA TTTTCAGGAG CTAAGGAAGC TAAAATGGAG
1021 AAAAAAATCA CTGGATATAC CACCGTTGAT ATATCCCAAT GGCATCGTAA AGAACATTTT
1081 GAGGCATTTC AGTCAGTTGC TCAATGTACC TATAACCAGA CCGTTCAGCT GGATATTACG
1141 GCCTTTTTAA AGACCGTAAA GAAAAATAAG CACAAGTTTT ATCCGGCCTT TATTCACATT
1201 CTTGCCCGCC TGATGAATGC TCATCCGGAA TTCCGTATGG CAATGAAAGA CGGTGAGCTG
1261 GTGATATGGG ATAGTGTTCA CCCTTGTTAC ACCGTTTTCC ATGAGCAAAC TGAAACGTTT
1321 TCATCGCTCT GGAGTGAATA CCACGACGAT TTCCGGCAGT TTCTACACAT ATATTCGCAA
1381 GATGTGGCGT GTTACGGTGA AAACCTGGCC TATTTCCCTA AAGGGTTTAT TGAGAATATG
1441 TTTTTCGTCT CAGCCAATCC CTGGGTGAGT TTCACCAGTT TTGATTTAAA CGTGGCCAAT
1501 ATGGACAACT TCTTCGCCCC CGTTTTCACC ATGGGCAAAT ATTATACGCA AGGCGACAAG
1561 GTGCTGATGC CGCTGGCGAT TCAGGTTCAT CATGCCGTCT GTGATGGCTT CCATGTCGGC
1621 AGAATGCTTA ATGAATTACA ACAGTACTGC GATGAGTGGC AGGGCGGGGC GTAAACGCGT
1681 GGATCCGGCT TACTAAAAGC CAGATAACAG TATGCGTATT TGCGCGCTGA TTTTTGCGGT
```

FIG.27B

```
1741 ATAAGAATAT ATACTGATAT GTATACCCGA AGTATGTCAA AAAGAGGTGT GCTATGAAGC
1801 AGCGTATTAC AGTGACAGTT GACAGCGACA GCTATCAGTT GCTCAAGGCA TATATGATGT
1861 CAATATCTCC GGTCTGGTAA GCACAACCAT GCAGAATGAA GCCCGTCGTC TGCGTGCCGA
1921 ACGCTGGAAA GCGGAAAATC AGGAAGGGAT GGCTGAGGTC GCCCGGTTTA TTGAAATGAA
1981 CGGCTCTTTT GCTGACGAGA ACAGGGACTG GTGAAATGCA GTTTAAGGTT TACACCTATA
2041 AAAGAGAGAG CCGTTATCGT CTGTTTGTGG ATGTACAGAG TGATATTATT GACACGCCCG
2101 GGCGACGGAT GGTGATCCCC CTGGCCAGTG CACGTCTGCT GTCAGATAAA GTCTCCCGTG
2161 AACTTTACCC GGTGGTGCAT ATCGGGGATG AAAGCTGGCG CATGATGACC ACCGATATGG
2221 CCAGTGTGCC GGTCTCCGTT ATCGGGGAAG AAGTGGCTGA TCTCAGCCAC CGCGAAAATG
2281 ACATCAAAAA CGCCATTAAC CTGATGTTCT GGGGAATATA AATGTCAGGC TCCCTTATAC
2341 ACAGCCAGTC TGCAGGTCGA CCATAGTGAC TGGATATGTT GTGTTTTACA GTATTATGTA
2401 GTCTGTTTTT TATGCAAAAT CTAATTTAAT ATATTGATAT TTATATCATT TTACGTTTCT
2461 CGTTCAGCTT TCTTGTACAA AGTGGTGATC GCGTGCATGC GACGTCATAG CTCTCTCCCT
2521 ATAGTGAGTC GTATTATAAG CTAGGCACTG GCCGTCGTTT TACAACGTCG TGACTGGGAA
2581 AACTGCTAGC TTGGGATCTT TGTGAAGGAA CCTTACTTCT GTGGTGTGAC ATAATTGGAC
2641 AAACTACCTA CAGAGATTTA AAGCTCTAAG GTAAATATAA AATTTTTAAG TGTATAATGT
2701 GTTAAACTAG CTGCATATGC TTGCTGCTTG AGAGTTTTGC TTACTGAGTA TGATTTATGA
2761 AAATATTATA CACAGGAGCT AGTGATTCTA ATTGTTTGTG TATTTTAGAT TCACAGTCCC
2821 AAGGCTCATT TCAGGCCCCT CAGTCCTCAC AGTCTGTTCA TGATCATAAT CAGCCATACC
2881 ACATTTGTAG AGGTTTTACT TGCTTTAAAA AACCTCCCAC ACCTCCCCCT GAACCTGAAA
2941 CATAAAATGA ATGCAATTGT TGTTGTTAAC TTGTTTATTG CAGCTTATAA TGGTTACAAA
3001 TAAAGCAATA GCATCACAAA TTTCACAAAT AAAGCATTTT TTTCACTGCA TTCTAGTTGT
3061 GGTTTGTCCA AACTCATCAA TGTATCTTAT CATGTCTGGA TCGATCCTGC ATTAATGAAT
3121 CGGCCAACGC GCGGGGAGAG GCGGTTTGCG TATTGGCTGG CGTAATAGCG AAGAGGCCCG
3181 CACCGATCGC CCTTCCCAAC AGTTGCGCAG CCTGAATGGC GAATGGGACG CGCCCTGTAG
3241 CGGCGCATTA AGCGCGGCGG GTGTGGTGGT TACGCGCAGC GTGACCGCTA CACTTGCCAG
3301 CGCCCTAGCG CCCGCTCCTT TCGCTTTCTT CCCTTCCTTT CTCGCCACGT TCGCCGGCTT
3361 TCCCCGTCAA GCTCTAAATC GGGGGCTCCC TTTAGGGTTC CGATTTAGTG CTTTACGGCA
3421 CCTCGACCCC AAAAAACTTG ATTAGGGTGA TGGTTCACGT AGTGGGCCAT CGCCCTGATA
3481 GACGGTTTTT CGCCCTTTGA CGTTGGAGTC CACGTTCTTT AATAGTGGAC TCTTGTTCCA
3541 AACTGGAACA ACACTCAACC CTATCTCGGT CTATTCTTTT GATTTATAAG GGATTTTGCC
3601 GATTTCGGCC TATTGGTTAA AAAATGAGCT GATTTAACAA AAATTTAACG CGAATTTTAA
3661 CAAAATATTA ACGTTTACAA TTTCAGGTGG CACTTTTCGG GGAAATGTGC GCGGAACCCC
3721 TATTTGTTTA TTTTTCTAAA TACATTCAAA TATGTATCCG CTCATGCCAG GTCTTGGACT
3781 GGTGAGAACG GCTTGCTCGG CAGCTTCGAT GTGTGCTGGA GGGAGAATAA AGGTCTAAGA
3841 TGTGCGATAG AGGGAAGTCG CATTGAATTA TGTGCTGTGT AGGGATCGCT GGTATCAAAT
3901 ATGTGTGCCC ACCCCTGGCA TGAGACAATA ACCCTGATAA ATGCTTCAAT AATATTGAAA
3961 AAGGAAGAGT ATGAGTATTC AACATTTCCG TGTCGCCCTT ATTCCCTTTT TTGCGGCATT
4021 TTGCCTTCCT GTTTTTGCTC ACCCAGAAAC GCTGGTGAAA GTAAAAGATG CTGAAGATCA
4081 GTTGGGTGCA CGAGTGGGTT ACATCGAACT GGATCTCAAC AGCGGTAAGA TCCTTGAGAG
4141 TTTTCGCCCC GAAGAACGTT TTCCAATGAT GAGCACTTTT AAAGTTCTGC TATGTGGCGC
```

FIG. 27C

```
4201 GGTATTATCC CGTATTGACG CCGGGCAAGA GCAACTCGGT CGCCGCATAC ACTATTCTCA
4261 GAATGACTTG GTTGAGTACT CACCAGTCAC AGAAAAGCAT CTTACGGATG GCATGACAGT
4321 AAGAGAATTA TGCAGTGCTG CCATAACCAT GAGTGATAAC ACTGCGGCCA ACTTACTTCT
4381 GACAACGATC GGAGGACCGA AGGAGCTAAC CGCTTTTTTG CACAACATGG GGGATCATGT
4441 AACTCGCCTT GATCGTTGGG AACCGGAGCT GAATGAAGCC ATACCAAACG ACGAGCGTGA
4501 CACCACGATG CCTGTAGCAA TGGCAACAAC GTTGCGCAAA CTATTAACTG GCGAACTACT
4561 TACTCTAGCT TCCCGGCAAC AATTAATAGA CTGGATGGAG GCGGATAAAG TTGCAGGACC
4621 ACTTCTGCGC TCGGCCCTTC CGGCTGGCTG GTTTATTGCT GATAAATCTG GAGCCGGTGA
4681 GCGTGGGTCT CGCGGTATCA TTGCAGCACT GGGGCCAGAT GGTAAGCCCT CCCGTATCGT
4741 AGTTATCTAC ACGACGGGGA GTCAGGCAAC TATGGATGAA CGAAATAGAC AGATCGCTGA
4801 GATAGGTGCC TCACTGATTA AGCATTGGTA ACTGTCAGAC CAAGTTTACT CATATATACT
4861 TTAGATTGAT TTAAAACTTC ATTTTTAATT TAAAAGGATC TAGGTGAAGA TCCTTTTTGA
4921 TAATCTCATG CCATAACTTC GTATAATGTA TGCTATACGA AGTTATGGCA TGACCAAAAT
4981 CCCTTAACGT GAGTTTTCGT TCCACTGAGC GTCAGACCCC GTAGAAAAGA TCAAAGGATC
5041 TTCTTGAGAT CCTTTTTTTC TGCGCGTAAT CTGCTGCTTG CAAACAAAAA AACCACCGCT
5101 ACCAGCGGTG GTTTGTTTGC CGGATCAAGA GCTACCAACT CTTTTTCCGA AGGTAACTGG
5161 CTTCAGCAGA GCGCAGATAC CAAATACTGT CCTTCTAGTG TAGCCGTAGT TAGGCCACCA
5221 CTTCAAGAAC TCTGTAGCAC CGCCTACATA CCTCGCTCTG CTAATCCTGT TACCAGTGGC
5281 TGCTGCCAGT GGCGATAAGT CGTGTCTTAC CGGGTTGGAC TCAAGACGAT AGTTACCGGA
5341 TAAGGCGCAG CGGTCGGGCT GAACGGGGGG TTCGTGCACA CAGCCCAGCT TGGAGCGAAC
5401 GACCTACACC GAACTGAGAT ACCTACAGCG TGAGCATTGA GAAAGCGCCA CGCTTCCCGA
5461 AGGGAGAAAG GCGGACAGGT ATCCGGTAAG CGGCAGGGTC GGAACAGGAG AGCGCACGAG
5521 GGAGCTTCCA GGGGGAAACG CCTGGTATCT TTATAGTCCT GTCGGGTTTC GCCACCTCTG
5581 ACTTGAGCGT CGATTTTTGT GATGCTCGTC AGGGGGGCGG AGCCTATGGA AAAACGCCAG
5641 CAACGCGGCC TTTTTACGGT TCCTGGCCTT TTGCTGGCCT TTTGCTCACA TGTTCTTTCC
5701 TGCGTTATCC CCTGATTCTG TGGATAACCG TATTACCGCC TTTGAGTGAG CTGATACCGC
5761 TCGCCGCAGC CGAACGACCG AGCGCAGCGA GTCAGTGAGC GAGGAAGCGG AAGAGCGCCC
5821 AATACGCAAA CCGCCTCTCC CCGCGCGTTG GCCGATTCAT TAATGCAGAG CTTGCAATTC
5881 GCGCGTTTTT CAATATTATT GAAGCATTTA TCAGGGTTAT TGTCTCATGA GCGGATACAT
5941 ATTTGAATGT ATTTAGAAAA ATAAACAAAT AGGGGTTCCG CGCACATTTC CCCGAAAAGT
6001 GCCACCTGAC GTCTAAGAAA CCATT
```

FIG.27D pDEST8 Polyhedron Promoter, Baculovirus Transfer Plasmid

```
    AccI
  1 cgt|ata ctc cgg aat att aat aga tca tgg aga taa tta aaa tga taa cca
      gca ta|t gag gcc tta taa tta tct agt acc tct att aat ttt act att ggt
                     ┌─mRNA (polyhedrin)
 52 tct cgc aaa taa ata|agt att tta ctg ttt tcg taa cag ttt tgt aat aaa
      aga gcg ttt att tat tca taa aat gac aaa agc att gtc aaa aca tta ttt 103 aaa acc tat aaa tat tcc gga tta ttc ata ccg tcc cac cat cgg gcg c̅g̅g̅
      ttt tgg ata ttt ata agg cct aat aag tat ggc agg gtg gta gcc cgc gcc
     (Bam)       Int      attR1
154 a̅t̅c̅ atc aca agt ttg tac aaa aaa gct gaa cga gaa acg taa aat gat ata
      tag tag tgt tca aac atg ttt ttt cga ctt gct ctt tgc att tta cta tat
```

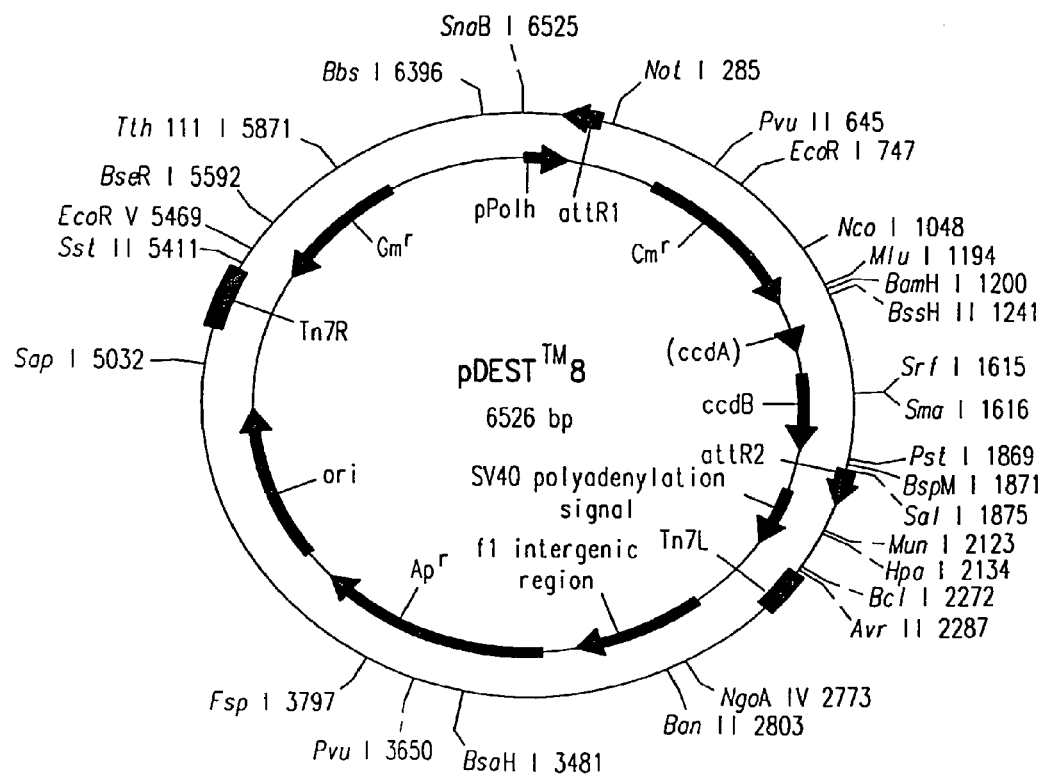

FIG.28A pDEST8 6526 bp

| Location (Base Nos.) | Gene Encoded |
|---|---|
| 23..152 | Ppolh |
| 284..160 | attR1 |
| 534..1193 | CmR |
| 1313..1397 | inactivated ccdA |
| 1535..1840 | ccdB |
| 1881..2005 | attR2 |
| 2766..3146 | f1 |
| 3240..4090 | ampR |
| 4289..4869 | ori |
| 5564..6496 | genR |

```
   1 CGTATACTCC GGAATATTAA TAGATCATGG AGATAATTAA AATGATAACC ATCTCGCAAA
  61 TAAATAAGTA TTTTACTGTT TTCGTAACAG TTTTGTAATA AAAAAACCTA TAAATATTCC
 121 GGATTATTCA TACCGTCCCA CCATCGGGCG CGGATCATCA CAAGTTTGTA CAAAAAAGCT
 181 GAACGAGAAA CGTAAAATGA TATAAATATC AATATATTAA ATTAGATTTT GCATAAAAAA
 241 CAGACTACAT AATACTGTAA AACACAACAT ATCCAGTCAC TATGGCGGCC GCTAAGTTGG
 301 CAGCATCACC CGACGCACTT TGCGCCGAAT AAATACCTGT GACGGAAGAT CACTTCGCAG
 361 AATAAATAAA TCCTGGTGTC CCTGTTGATA CCGGGAAGCC CTGGGCCAAC TTTTGGCGAA
 421 AATGAGACGT TGATCGGCAC GTAAGAGGTT CCAACTTTCA CCATAATGAA ATAAGATCAC
 481 TACCGGGCGT ATTTTTTGAG TTATCGAGAT TTTCAGGAGC TAAGGAAGCT AAAATGGAGA
 541 AAAAAATCAC TGGATATACC ACCGTTGATA TATCCCAATG GCATCGTAAA GAACATTTTG
 601 AGGCATTTCA GTCAGTTGCT CAATGTACCT ATAACCAGAC CGTTCAGCTG GATATTACGG
 661 CCTTTTTTAAA GACCGTAAAG AAAAATAAGC ACAAGTTTTA TCCGGCCTTT ATTCACATTC
 721 TTGCCCGCCT GATGAATGCT CATCCGGAAT TCCGTATGGC AATGAAAGAC GGTGAGCTGG
 781 TGATATGGGA TAGTGTTCAC CCTTGTTACA CCGTTTTCCA TGAGCAAACT GAAACGTTTT
 841 CATCGCTCTG GAGTGAATAC CACGACGATT TCCGGCAGTT TCTACACATA TATTCGCAAG
 901 ATGTGGCGTG TTACGGTGAA AACCTGGCCT ATTTCCCTAA AGGGTTTATT GAGAATATGT
 961 TTTTCGTCTC AGCCAATCCC TGGGTGAGTT TCACCAGTTT TGATTTAAAC GTGGCCAATA
1021 TGGACAACTT CTTCGCCCCC GTTTTCACCA TGGGCAAATA TTATACGCAA GGCGACAAGG
1081 TGCTGATGCC GCTGGCGATT CAGGTTCATC ATGCCGTCTG TGATGGCTTC CATGTCGGCA
1141 GAATGCTTAA TGAATTACAA CAGTACTGCG ATGAGTGGCA GGGCGGGGCG TAAACGCGTG
1201 GATCCGGCTT ACTAAAAGCC AGATAACAGT ATGCGTATTT GCGCGCTGAT TTTTGCGGTA
1261 TAAGAATATA TACTGATATG TATACCCGAA GTATGTCAAA AAGAGGTGTG CTATGAAGCA
1321 GCGTATTACA GTGACAGTTG ACAGCGACAG CTATCAGTTG CTCAAGGCAT ATATGATGTC
1381 AATATCTCCG GTCTGGTAAG CACAACCATG CAGAATGAAG CCCGTCGTCT GCGTGCCGAA
1441 CGCTGGAAAG CGGAAAATCA GGAAGGGATG GCTGAGGTCG CCCGGTTTAT TGAAATGAAC
1501 GGCTCTTTTG CTGACAGAGA CAGGGACTGG TGAAATGCAG TTTAAGGTTT ACACCTATAA
1561 AAGAGAGAGC CGTTATCGTC TGTTTGTGGA TGTACAGAGT GATATTATTG ACACGCCCGG
1621 GCGACGGATG GTGATCCCCC TGGCCAGTGC ACGTCTGCTG TCAGATAAAG TCTCCCGTGA
1681 ACTTTACCCG GTGGTGCATA TCGGGGATGA AAGCTGGCGC ATGATGACCA CCGATATGGC
```

FIG.28B

```
1741 CAGTGTGCCG GTCTCCGTTA TCGGGGAAGA AGTGGCTGAT CTCAGCCACC GCGAAAATGA
1801 CATCAAAAAC GCCATTAACC TGATGTTCTG GGGAATATAA ATGTCAGGCT CCCTTATACA
1861 CAGCCAGTCT GCAGGTCGAC CATAGTGACT GGATATGTTG TGTTTTACAG TATTATGTAG
1921 TCTGTTTTTT ATGCAAAATC TAATTTAATA TATTGATATT TATATCATTT TACGTTTCTC
1981 GTTCAGCTTT CTTGTACAAA GTGGTGATAG CTTGTCGAGA AGTACTAGAG GATCATAATC
2041 AGCCATACCA CATTTGTAGA GGTTTTACTT GCTTTAAAAA ACCTCCCACA CCTCCCCCTG
2101 AACCTGAAAC ATAAAATGAA TGCAATTGTT GTTGTTAACT TGTTTATTGC AGCTTATAAT
2161 GGTTACAAAT AAAGCAATAG CATCACAAAT TTCACAAATA AAGCATTTTT TTCACTGCAT
2221 TCTAGTTGTG GTTTGTCCAA ACTCATCAAT GTATCTTATC ATGTCTGGAT CTGATCACTG
2281 CTTGAGCCTA GGAGATCCGA ACCAGATAAG TGAAATCTAG TTCCAAACTA TTTTTGTCATT
2341 TTTAATTTTC GTATTAGCTT ACGACGCTAC ACCCAGTTCC CATCTATTTT GTCACTCTTC
2401 CCTAAATAAT CCTTAAAAAC TCCATTTCCA CCCCTCCCAG TTCCCAACTA TTTTGTCCGC
2461 CCACAGCGGG GCATTTTTCT TCCTGTTATG TTTTTAATCA AACATCCTGC CAACTCCATG
2521 TGACAAACCG TCATCTTCGG CTACTTTTTC TCTGTCACAG AATGAAAATT TTTCTGTCAT
2581 CTCTTCGTTA TTAATGTTTG TAATTGACTG AATATCAACG CTTATTTGCA GCCTGAATGG
2641 CGAATGGACG CGCCCTGTAG CGGCGCATTA AGCGCGGCGG GTGTGGTGGT TACGCGCAGC
2701 GTGACCGCTA CACTTGCCAG CGCCCTAGCG CCCGCTCCTT TCGCTTTCTT CCCTTCCTTT
2761 CTCGCCACGT TCGCCGGCTT TCCCCGTCAA GCTCTAAATC GGGGGCTCCC TTTAGGGTTC
2821 CGATTTAGTG CTTTACGGCA CCTCGACCCC AAAAAACTTG ATTAGGGTGA TGGTTCACGT
2881 AGTGGGCCAT CGCCCTGATA GACGGTTTTT CGCCCTTTGA CGTTGGAGTC CACGTTCTTT
2941 AATAGTGGAC TCTTGTTCCA AACTGGAACA ACACTCAACC CTATCTCGGT CTATTCTTTT
3001 GATTTATAAG GGATTTTGCC GATTTCGGCC TATTGGTTAA AAAATGAGCT GATTTAACAA
3061 AAATTTAACG CGAATTTTAA CAAAATATTA ACGTTTACAA TTTCAGGTGG CACTTTTCGG
3121 GGAAATGTGC GCGGAACCCC TATTTGTTTA TTTTTCTAAA TACATTCAAA TATGTATCCG
3181 CTCATGAGAC AATAACCCTG ATAAATGCTT CAATAATATT GAAAAAGGAA GAGTATGAGT
3241 ATTCAACATT TCCGTGTCGC CCTTATTCCC TTTTTTGCGG CATTTTGCCT TCCTGTTTTT
3301 GCTCACCCAG AAACGCTGGT GAAAGTAAAA GATGCTGAAG ATCAGTTGGG TGCACGAGTG
3361 GGTTACATCG AACTGGATCT CAACAGCGGT AAGATCCTTG AGAGTTTTCG CCCCGAAGAA
3421 CGTTTTCCAA TGATGAGCAC TTTTAAAGTT CTGCTATGTG GCGCGGTATT ATCCCGTATT
3481 GACGCCGGGC AAGAGCAACT CGGTCGCCGC ATACACTATT CTCAGAATGA CTTGGTTGAG
3541 TACTCACCAG TCACAGAAAA GCATCTTACG GATGGCATGA CAGTAAGAGA ATTATGCAGT
3601 GCTGCCATAA CCATGAGTGA TAACACTGCG GCCAACTTAC TTCTGACAAC GATCGGAGGA
3661 CCGAAGGAGC TAACCGCTTT TTTGCACAAC ATGGGGGATC ATGTAACTCG CCTTGATCGT
3721 TGGGAACCGG AGCTGAATGA AGCCATACCA AACGACGAGC GTGACACCAC GATGCCTGTA
3781 GCAATGGCAA CAACGTTGCG CAAACTATTA ACTGGCGAAC TACTTACTCT AGCTTCCCGG
3841 CAACAATTAA TAGACTGGAT GGAGGCGGAT AAAGTTGCAG GACCACTTCT GCGCTCGGCC
3901 CTTCCGGCTG GCTGGTTTAT TGCTGATAAA TCTGGAGCCG GTGAGCGTGG GTCTCGCGGT
3961 ATCATTGCAG CACTGGGGCC AGATGGTAAG CCCTCCCGTA TCGTAGTTAT CTACACGACG
4021 GGGAGTCAGG CAACTATGGA TGAACGAAAT AGACAGATCG CTGAGATAGG TGCCTCACTG
4081 ATTAAGCATT GGTAACTGTC AGACCAAGTT TACTCATATA TACTTTAGAT TGATTTAAAA
4141 CTTCATTTTT AATTTAAAAG GATCTAGGTG AAGATCCTTT TTGATAATCT CATGACCAAA
```

FIG.28C

```
4201 ATCCCTTAAC GTGAGTTTTC GTTCCACTGA GCGTCAGACC CCGTAGAAAA GATCAAAGGA
4261 TCTTCTTGAG ATCCTTTTTT TCTGCGCGTA ATCTGCTGCT TGCAAACAAA AAAACCACCG
4321 CTACCAGCGG TGGTTTGTTT GCCGGATCAA GAGCTACCAA CTCTTTTTCC GAAGGTAACT
4381 GGCTTCAGCA GAGCGCAGAT ACCAAATACT GTCCTTCTAG TGTAGCCGTA GTTAGGCCAC
4441 CACTTCAAGA ACTCTGTAGC ACCGCCTACA TACCTCGCTC TGCTAATCCT GTTACCAGTG
4501 GCTGCTGCCA GTGGCGATAA GTCGTGTCTT ACCGGGTTGG ACTCAAGACG ATAGTTACCG
4561 GATAAGGCGC AGCGGTCGGG CTGAACGGGG GGTTCGTGCA CACAGCCCAG CTTGGAGCGA
4621 ACGACCTACA CCGAACTGAG ATACCTACAG CGTGAGCATT GAGAAAGCGC CACGCTTCCC
4681 GAAGGGAGAA AGGCGGACAG GTATCCGGTA AGCGGCAGGG TCGGAACAGG AGAGCGCACG
4741 AGGGAGCTTC CAGGGGGAAA CGCCTGGTAT CTTTATAGTC CTGTCGGGTT TCGCCACCTC
4801 TGACTTGAGC GTCGATTTTT GTGATGCTCG TCAGGGGGGC GGAGCCTATG GAAAAACGCC
4861 AGCAACGCGG CCTTTTTACG GTTCCTGGCC TTTTGCTGGC CTTTTGCTCA CATGTTCTTT
4921 CCTGCGTTAT CCCCTGATTC TGTGGATAAC CGTATTACCG CCTTTGAGTG AGCTGATACC
4981 GCTCGCCGCA GCCGAACGAC CGAGCGCAGC GAGTCAGTGA GCGAGGAAGC GGAAGAGCGC
5041 CTGATGCGGT ATTTTCTCCT TACGCATCTG TGCGGTATTT CACACCGCAG ACCAGCCGCG
5101 TAACCTGGCA AAATCGGTTA CGGTTGAGTA ATAAATGGAT GCCCTGCGTA AGCGGGTGTG
5161 GGCGGACAAT AAAGTCTTAA ACTGAACAAA ATAGATCTAA ACTATGACAA TAAAGTCTTA
5221 AACTAGACAG AATAGTTGTA AACTGAAATC AGTCCAGTTA TGCTGTGAAA AAGCATACTG
5281 GACTTTTGTT ATGGCTAAAG CAAACTCTTC ATTTTCTGAA GTGCAAATTG CCCGTCGTAT
5341 TAAAGAGGGG CGTGGCCAAG GCATGGTAA AGACTATATT CGCGGCGTTG TGACAATTTA
5401 CCGAACAACT CCGCGGCCGG GAAGCCGATC TCGGCTTGAA CGAATTGTTA GGTGGCGGTA
5461 CTTGGGTCGA TATCAAAGTG CATCACTTCT TCCCGTATGC CCAACTTTGT ATAGAGAGCC
5521 ACTGCGGGAT CGTCACCGTA ATCTGCTTGC ACGTAGATCA CATAAGCACC AAGCGCGTTG
5581 GCCTCATGCT TGAGGAGATT GATGAGCGCG GTGGCAATGC CCTGCCTCCG GTGCTCGCCG
5641 GAGACTGCGA GATCATAGAT ATAGATCTCA CTACGCGGCT GCTCAAACCT GGGCAGAACG
5701 TAAGCCGCGA GAGCGCCAAC AACCGCTTCT TGGTCGAAGG CAGCAAGCGC GATGAATGTC
5761 TTACTACGGA GCAAGTTCCC GAGGTAATCG GAGTCCGGCT GATGTTGGGA GTAGGTGGCT
5821 ACGTCTCCGA ACTCACGACC GAAAAGATCA AGAGCAGCCC GCATGGATTT GACTTGGTCA
5881 GGGCCGAGCC TACATGTGCG AATGATGCCC ATACTTGAGC CACCTAACTT TGTTTTAGGG
5941 CGACTGCCCT GCTGCGTAAC ATCGTTGCTG CTGCGTAACA TCGTTGCTGC TCCATAACAT
6001 CAAACATCGA CCCACGGCGT AACGCGCTTG CTGCTTGGAT GCCCGAGGCA TAGACTGTAC
6061 AAAAAAACAG TCATAACAAG CCATGAAAAC CGCCACTGCG CCGTTACCAC CGCTGCGTTC
6121 GGTCAAGGTT CTGGACCAGT TGCGTGAGCG CATACGCTAC TTGCATTACA GTTTACGAAC
6181 CGAACAGGCT TATGTCAACT GGGTTCGTGC CTTCATCCGT TTCCACGGTG TGCGTCACCC
6241 GGCAACCTTG GGCAGCAGCG AAGTCGAGGC ATTTCTGTCC TGGCTGGCGA ACGAGCGCAA
6301 GGTTTCGGTC TCCACGCATC GTCAGGCATT GGCGGCCTTG CTGTTCTTCT ACGGCAAGGT
6361 GCTGTGCACG GATCTGCCCT GGCTTCAGGA GATCGGAAGA CCTCGGCCGT CGCGGCGCTT
6421 GCCGGTGGTG CTGACCCCGG ATGAAGTGGT TCGCATCCTC GGTTTTCTGG AAGGCGAGCA
6481 TCGTTTGTTC GCCCAGGACT CTAGCTATAG TTCTAGTGGT TGGCTA
```

FIG.28D

SEMLIKI FOREST VIRUS VECTOR

```
103 ttg gcg agg gac att aag gcg ttt aag aaa ttg aga gga cct gtt ata cac
    aac cgc tcc ctg taa ttc cgc aaa ttc ttt aac tct cct gga caa tat gtg 26s PROMOTER          26s RNA                              Bam
154 ctc tac ggc ggt cct aga ttg gtg cgt taa tac aca gaa ttc tga ttg gat
    gag atg ccg cca gga tct aac cac gca att atg tgt ctt aag act aac cta RsrII                                    Int      attR1
205 ccc ggt ccg aag cgc gct tcc cca tca aca agt ttg tac aaa aaa gct gaa
    ggg cca ggc ttc gcg cga agg ggt agt tgt tca aac atg ttt ttt cga ctt
```

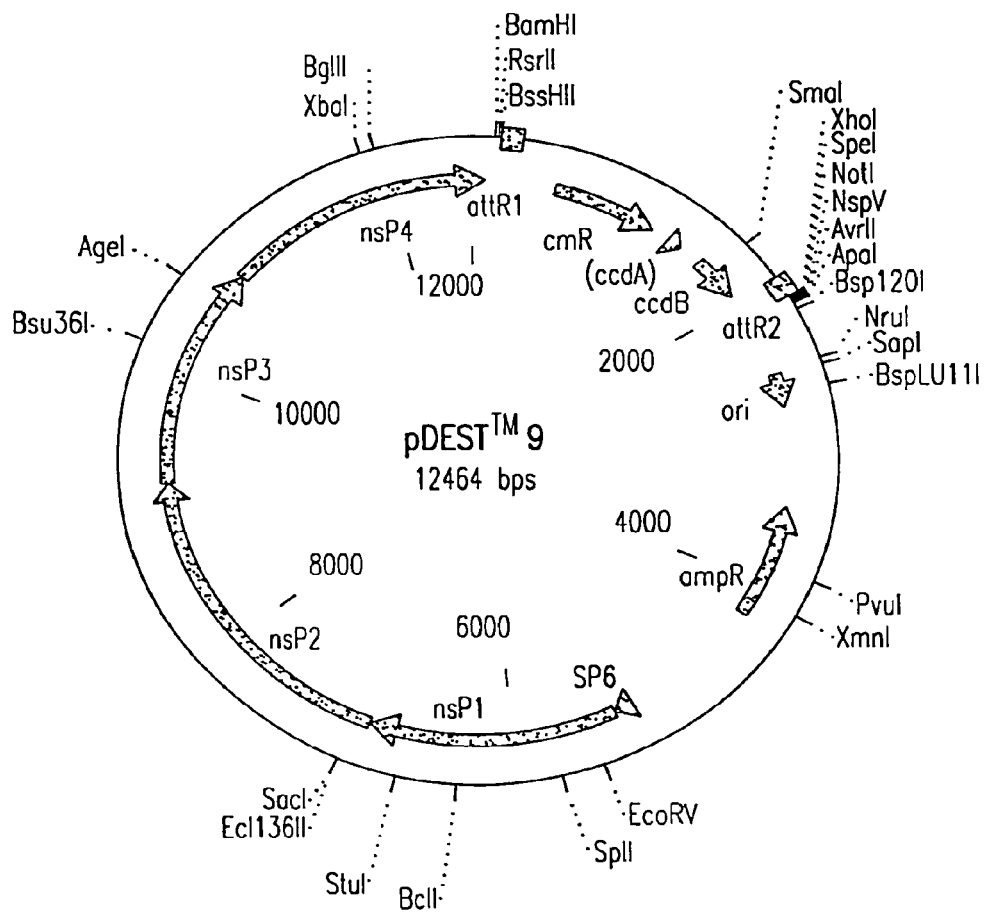

FIG. 29A pDEST9 12464 bp

| Location (Base Nos.) | Gene Encoded |
|---|---|
| 355..232 | attR1 |
| 605..1264 | CmR |
| 1384..1468 | inactivated ccdA |
| 1606..1911 | ccdB |
| 1952..2078 | attR2 |
| 2532..2782 | ori |
| 3482..4282 | ampR |
| 5232..5365 | SP6 promoter |
| 5365..6965 | nsP1:non-structural protein 1 |
| 6965..9265 | nsP2:non-structural protein 2 |
| 9265..10865 | nsP3:non-structural protein 3 |
| 10865..161 | nsP4:non-structural protein 4 |

```
   1 AGCAAGTGGT TCCGGACAGG CTTGGGGGCC GAACTGGAGG TGGCACTAAC ATCTAGGTAT
  61 GAGGTAGAGG GCTGCAAAAG TATCCTCATA GCCATGGCCA CCTTGGCGAG GGACATTAAG
 121 GCGTTTAAGA AATTGAGAGG ACCTGTTATA CACCTCTACG GCGGTCCTAG ATTGGTGCGT
 181 TAATACACAG AATTCTGATT GGATCCCGGT CCGAAGCGCG CTTTCCCATC ACAAGTTTGT
 241 ACAAAAAAGC TGAACGAGAA ACGTAAAATG ATATAAATAT CAATATATTA AATTAGATTT
 301 TGCATAAAAA ACAGACTACA TAATACTGTA AAACACAACA TATCCAGTCA CTATGGCGGC
 361 CGCTAAGTTG GCAGCATCAC CCGACGCACT TTGCGCCGAA TAAATACCTG TGACGGAAGA
 421 TCACTTCGCA GAATAAATAA ATCCTGGTGT CCCTGTTGAT ACCGGGAAGC CCTGGGCCAA
 481 CTTTTGGCGA AAATGAGACG TTGATCGGCA CGTAAGAGGT TCCAACTTTC ACCATAATGA
 541 AATAAGATCA CTACCGGGCG TATTTTTTGA GTTATCGAGA TTTTCAGGAG CTAAGGAAGC
 601 TAAAATGGAG AAAAAAATCA CTGGATATAC CACCGTTGAT ATATCCCAAT GGCATCGTAA
 661 AGAACATTTT GAGGCATTTC AGTCAGTTGC TCAATGTACC TATAACCAGA CCGTTCAGCT
 721 GGATATTACG GCCTTTTTAA AGACCGTAAA GAAAAATAAG CACAAGTTTT ATCCGGCCTT
 781 TATTCACATT CTTGCCCGCC TGATGAATGC TCATCCGGAA TTCCGTATGG CAATGAAAGA
 841 CGGTGAGCTG GTGATATGGG ATAGTGTTCA CCCTTGTTAC ACCGTTTTCC ATGAGCAAAC
 901 TGAAACGTTT TCATCGCTCT GGAGTGAATA CCACGACGAT TTCCGGCAGT TTCTACACAT
 961 ATATTCGCAA GATGTGGCGT GTTACGGTGA AAACCTGGCC TATTTCCCTA AAGGGTTTAT
1021 TGAGAATATG TTTTTCGTCT CAGCCAATCC CTGGGTGAGT TTCACCAGTT TTGATTTAAA
1081 CGTGGCCAAT ATGGACAACT TCTTCGCCCC CGTTTTCACC ATGGGCAAAT ATTATACGCA
1141 AGGCGACAAG GTGCTGATGC CGCTGGCGAT TCAGGTTCAT CATGCCGTCT GTGATGGCTT
1201 CCATGTCGGC AGAATGCTTA ATGAATTACA ACAGTACTGC GATGAGTGGC AGGGCGGGGC
1261 GTAAAGATCT GGATCCGGCT TACTAAAAGC CAGATAACAG TATGCGTATT TGCGCGCTGA
1321 TTTTTGCGGT ATAAGAATAT ATACTGATAT GTATACCCGA AGTATGTCAA AAAGAGGTGT
1381 GCTATGAAGC AGCGTATTAC AGTGACAGTT GACAGCGACA GCTATCAGTT GCTCAAGGCA
1441 TATATGATGT CAATATCTCC GGTCTGGTAA GCACAACCAT GCAGAATGAA GCCCGTCGTC
1501 TGCGTGCCGA ACGCTGGAAA GCGGAAAATC AGGAAGGGAT GGCTGAGGTC GCCCGGTTTA
1561 TTGAAATGAA CGGCTCTTTT GCTGACGAGA CAGGGACTG GTGAAATGCA GTTTAAGGTT
```

FIG.29B

```
1621 TACACCTATA AAAGAGAGAG CCGTTATCGT CTGTTTGTGG ATGTACAGAG TGATATTATT
1681 GACACGCCCG GGCGACGGAT GGTGATCCCC CTGGCCAGTG CACGTCTGCT GTCAGATAAA
1741 GTCTCCCGTG AACTTTACCC GGTGGTGCAT ATCGGGGATG AAAGCTGGCG CATGATGACC
1801 ACCGATATGG CCAGTGTGCC GGTCTCCGTT ATCGGGGAAG AAGTGGCTGA TCTCAGCCAC
1861 CGCGAAAATG ACATCAAAAA CGCCATTAAC CTGATGTTCT GGGGAATATA AATGTCAGGC
1921 TCCCTTATAC ACAGCCAGTC TGCAGGTCGA CCATAGTGAC TGGATATGTT GTGTTTTACA
1981 GTATTATGTA GTCTGTTTTT TATGCAAAAG TGCTAATTTA ATATATTGAT ATTTATATCA
2041 TTTTACGTTT CTCGTTCAGC TTTCTTGTAC AAAGTGGTGA TGGGAACTCG AGTTCACTAG
2101 TCGATCCCGC GGCCGCTTTC GAACCTAGGC AAGCATGCGG GCCCAGTGGG TAATTAATTG
2161 AATTACATCC CTACGCAAAC GTTTTACGGC CGCCGGTGGC GCCCGCGCCC GGCGGCCCGT
2221 CCTTGGCCGT TGCAGGCCAC TCCGGTGGCT CCCGTCGTCC CGACTTCCA GGCCCAGCAG
2281 ATGCAGCAAC TCATCAGCGC CGTAAATGCG CTGACAATGA GACAGAACGC AATTGCTCCT
2341 GCTAGGAGCT TAATTCGACG AATAATTGGA TTTTTATTTT ATTTTGCAAT TGGTTTTTAA
2401 TATTTCCAAA AAAAAAAAAA AAAAAAAAAA AAAAAAAAAA AAAAAAAAAA
2461 AAAAAAAAAA AAAAAAACTA GAAATCGCGA TTTCTAGTCT GCATTAATGA ATCGGCCAAC
2521 GCGCGGGGAG AGGCGGTTTG CGTATTGGGC GCTCTTCCGC TTCCTCGCTC ACTGACTCGC
2581 TGCGCTCGGT CGTTCGGCTG CGGCGAGCGG TATCAGCTCA CTCAAAGGCG GTAATACGGT
2641 TATCCACAGA ATCAGGGGAT AACGCAGGAA AGAACATGTG AGCAAAAGGC CAGCAAAAGG
2701 CCAGGAACCG TAAAAAGGCC GCGTTGCTGG CGTTTTTCCA TAGGCTCCGC CCCCCTGACG
2761 AGCATCACAA AAATCGACGC TCAAGTCAGA GGTGGCGAAA CCCGACAGGA CTATAAAGAT
2821 ACCAGGCGTT TCCCCCTGGA AGCTCCCTCG TGCGCTCTCC TGTTCCGACC CTGCCGCTTA
2881 CCGGATACCT GTCCGCCTTT CTCCCTTCGG GAAGCGTGGC GCTTTCTCAA TGCTCGCGCT
2941 GTAGGTATCT CAGTTCGGTG TAGGTCGTTC GCTCCAAGCT GGGCTGTGTG CACGAACCCC
3001 CCGTTCAGCC CGACCGCTGC GCCTTATCCG GTAACTATCG TCTTGAGTCC AACCCGGTAA
3061 GACACGACTT ATCGCCACTG GCAGCAGCCA CTGGTAACAG GATTAGCAGA GCGAGGTATG
3121 TAGGCGGTGC TACAGAGTTC TTGAAGTGGT GGCCTAACTA CGGCTACACT AGAAGGACAG
3181 TATTTGGTAT CTGCGCTCTG CTGAAGCCAG TTACCTTCGG AAAAAGAGTT GGTAGCTCTT
3241 GATCCGGCAA ACAAACCACC GCTGGTAGCG GTGGTTTTTT TGTTTGCAAG CAGCAGATTA
3301 CGCGCAGAAA AAAAGGATCT CAAGAAGATC CTTTGATCTT TTCTACGGGG TCTGACGCTC
3361 AGTGGAACGA AAACTCACGT TAAGGGATTT TGGTCATGAG ATTATCAAAA AGGATCTTCA
3421 CCTAGATCCT TTTAAATTAA AAATGAAGTT TTAAATCAAT CTAAAGTATA TATGAGTAAA
3481 CTTGGTCTGA CAGTTACCAA TGCTTAATCA GTGAGGCACC TATCTCAGCG ATCTGTCTAT
3541 TTCGTTCATC CATAGTTGCC TGACTCCCCG TCGTGTAGAT AACTACGATA CGGGAGGGCT
3601 TACCATCTGG CCCCAGTGCT GCAATGATAC CGCGAGACCC ACGCTCACCG GCTCCAGATT
3661 TATCAGCAAT AAACCAGCCA GCCGGAAGGG CCGAGCGCAG AAGTGGTCCT GCAACTTTAT
3721 CCGCCTCCAT CCAGTCTATT AATTGTTGCC GGGAAGCTAG AGTAAGTAGT TCGCCAGTTA
3781 ATAGTTTGCG CAACGTTGTT GCCATTGCTA CAGGCATCGT GGTGTCACGC TCGTCGTTTG
3841 GTATGGCTTC ATTCAGCTCC GGTTCCCAAC GATCAAGGCG AGTTACATGA TCCCCCATGT
3901 TGTGCAAAAA AGCGGTTAGC TCCTTCGGTC CTCCGATCGT TGTCAGAAGT AAGTTGGCCG
3961 CAGTGTTATC ACTCATGGTT ATGGCAGCAC TGCATAATTC TCTTACTGTC ATGCCATCCG
4021 TAAGATGCTT TTCTGTGACT GGTGAGTACT CAACCAAGTC ATTCTGAGAA TAGTGTATGC
```

FIG.29C

```
4081 GGCGACCGAG TTGCTCTTGC CCGGCGTCAA TACGGGATAA TACCGCGCCA CATAGCAGAA
4141 CTTTAAAAGT GCTCATCATT GGAAAACGTT CTTCGGGGCG AAAACTCTCA AGGATCTTAC
4201 CGCTGTTGAG ATCCAGTTCG ATGTAACCCA CTCGTGCACC CAACTGATCT TCAGCATCTT
4261 TTACTTTCAC CAGCGTTTCT GGGTGAGCAA AAACAGGAAG GCAAAATGCC GCAAAAAAGG
4321 GAATAAGGGC GACACGGAAA TGTTGAATAC TCATACTCTT CCTTTTTCAA TATTATTGAA
4381 GCATTTATCA GGGTTATTGT CTCATGAGCG GATACATATT TGAATGTATT TAGAAAAATA
4441 AACAAATAGG GGTTCCGCGC ACATTTCCCC GAAAAGTGCC ACCTGACGTC TAAGAAACCA
4501 TTATTATCAT GACATTAACC TATAAAAATA GGCGTATCAC GAGGCCCTTT CGTCTCGCGC
4561 GTTTCGGTGA TGACGGTGAA AACCTCTGAC ACATGCAGCT CCCGGAGACG GTCACAGCTT
4621 CTGTCTAAGC GGATGCCGGG AGCAGACAAG CCCGTCAGGG CGCGTCAGCG GGTGTTGGCG
4681 GGTGTCGGGG CTGGCTTAAC TATGCGGCAT CAGAGCAGAT TGTACTGAGA GTGCACCATA
4741 TCGACGCTCT CCCTTATGCG ACTCCTGCAT TAGGAAGCAG CCCAGTACTA GGTTGAGGCC
4801 GTTGAGCACC GCCGCCGCAA GGAATGGTGC ATGCAAGGAG ATGGCGCCCA ACAGTCCCCC
4861 GGCCACGGGG CCTGCCACCA TACCCACGCC GAAACAAGCG CTCATGAGCC CGAAGTGGCG
4921 AGCCCGATCT TCCCCATCGG TGATGTCGGC GATATAGGCG CCAGCAACCG CACCTGTGGC
4981 GCCGGTGATG CCGGCCACGA TGCGTCCGGC GTAGAGGATC TGGCTAGCGA TGACCCTGCT
5041 GATTGGTTCG CTGACCATTT CCGGGGTGCG GAACGGCGTT ACCAGAAACT CAGAAGGTTC
5101 GTCCAACCAA ACCGACTCTG ACGGCAGTTT ACGAGAGAGA TGATAGGGTC TGCTTCAGTA
5161 AGCCAGATGC TACACAATTA GGCTTGTACA TATTGTCGTT AGAACGCGGC TACAATTAAT
5221 ACATAACCTT ATGTATCATA CACATACGAT TTAGGTGACA CTATAGATGG CGGATGTGTG
5281 ACATACACGA CGCCAAAAGA TTTTGTTCCA GCTCCTGCCA CCTCCGCTAC GCGAGAGATT
5341 AACCACCCAC GATGGCCGCC AAAGTGCATG TTGATATTGA GGCTGACAGC CCATTCATCA
5401 AGTCTTTGCA GAAGGCATTT CCGTCGTTCG AGGTGGAGTC ATTGCAGGTC ACACCAAATG
5461 ACCATGCAAA TGCCAGAGCA TTTTCGCACC TGGCTACCAA ATTGATCGAG CAGGAGACTG
5521 ACAAAGACAC ACTCATCTTG GATATCGGCA GTGCGCCTTC CAGGAGAATG ATGTCTACGC
5581 ACAAATACCA CTGCGTATGC CCTATGCGCA GCGCAGAAGA CCCCGAAAGG CTCGATAGCT
5641 ACGCAAAGAA ACTGGCAGCG GCCTCCGGGA AGGTGCTGGA TAGAGAGATC GCAGGAAAAA
5701 TCACCGACCT GCAGACCGTC ATGGCTACGC CAGACGCTGA ATCTCCTACC TTTTGCCTGC
5761 ATACAGACGT CACGTGTCGT ACGGCAGCCG AAGTGGCCGT ATACCAGGAC GTGTATGCTG
5821 TACATGCACC AACATCGCTG TACCATCAGG CGATGAAAGG TGTCAGAACG GCGTATTGGA
5881 TTGGGTTTGA CACCACCCCG TTTATGTTTG ACGCGCTAGC AGGCGCGTAT CCAACCTACG
5941 CCACAAACTG GGCCGACGAG CAGGTGTTAC AGGCCAGGAA CATAGGACTG TGTGCAGCAT
6001 CCTTGACTGA GGGAAGACTC GGCAAACTGT CCATTCTCCG CAAGAAGCAA TTGAAACCTT
6061 GCGACACAGT CATGTTCTCG GTAGGATCTA CATTGTACAC TGAGAGCAGA AAGCTACTGA
6121 GGAGCTGGCA CTTACCCTCC GTATTCCACC TGAAAGGTAA ACAATCCTTT ACCTGTAGGT
6181 GCGATACCAT CGTATCATGT GAAGGGTACG TAGTTAAGAA AATCACTATG TGCCCCGGCC
6241 TGTACGGTAA AACGGTAGGG TACGCCGTGA CGTATCACGC GGAGGGATTC CTAGTGTGCA
6301 AGACCACAGA CACTGTCAAA GGAGAAAGAG TCTCATTCCC TGTATGCACC TACGTCCCCT
6361 CAACCATCTG TGATCAAATG ACTGGCATAC TAGCGACCGA CGTCACACCG GAGGACGCAC
6421 AGAAGTTGTT AGTGGGATTG AATCAGAGGA TAGTTGTGAA CGGAAGAACA CAGCGAAACA
6481 CTAACACGAT GAAGAACTAT CTGCTTCCGA TTGTGGCCGT CGCATTTAGC AAGTGGGCGA
```

FIG.29D

```
6541 GGGAATACAA GGCAGACCTT GATGATGAAA AACCTCTGGG TGTCCGAGAG AGGTCACTTA
6601 CTTGCTGCTG CTTGTGGGCA TTTAAAACGA GGAAGATGCA CACCATGTAC AAGAAACCAG
6661 ACACCCAGAC AATAGTGAAG GTGCCTTCAG AGTTTAACTC GTTCGTCATC CCGAGCCTAT
6721 GGTCTACAGG CCTCGCAATC CCAGTCAGAT CACGCATTAA GATGCTTTTG GCCAAGAAGA
6781 CCAAGCGAGA GTTAATACCT GTTCTCGACG CGTCGTCAGC CAGGGATGCT GAACAAGAGG
6841 AGAAGGAGAG GTTGGAGGCC GAGCTGACTA GAGAAGCCTT ACCACCCCTC GTCCCCATCG
6901 CGCCGGCGGA GACGGGAGTC GTCGACGTCG ACGTTGAAGA ACTAGAGTAT CACGCAGGTG
6961 CAGGGGTCGT GGAAACACCT CGCAGCGCGT TGAAAGTCAC CGCACAGCCG AACGACGTAC
7021 TACTAGGAAA TTACGTAGTT CTGTCCCCGC AGACCGTGCT CAAGAGCTCC AAGTTGGCCC
7081 CCGTGCACCC TCTAGCAGAG CAGGTGAAAA TAATAACACA TAACGGGAGG GCCGGCGGTT
7141 ACCAGGTCGA CGGATATGAC GGCAGGGTCC TACTACCATG TGGATCGGCC ATTCCGGTCC
7201 CTGAGTTTCA GGCTTTGAGC GAGAGCGCCA CTATGGTGTA CAACGAAAGG GAGTTCGTCA
7261 ACAGGAAACT ATACCATATT GCCGTTCACG GACCCTCGCT GAACACCGAC GAGGAGAACT
7321 ACGAGAAAGT CAGAGCTGAA AGAACTGACG CCGAGTACGT GTTCGACGTA GATAAAAAAT
7381 GCTGCGTCAA GAGAGAGGAA GCGTCGGGTT TGGTGTTGGT GGGAGAGCTA ACCAACCCCC
7441 CGTTCCATGA ATTCGCCTAC GAAGGGCTGA AGATCAGGCC GTCGGCACCA TATAAGACTA
7501 CAGTAGTAGG AGTCTTTGGG GTTCCGGGAT CAGGCAAGTC TGCTATTATT AAGAGCCTCG
7561 TGACCAAACA CGATCTGGTC ACCAGCGGCA AGAAGGAGAA CTGCCAGGAA ATAGTTAACG
7621 ACGTGAAGAA GCACCGCGGG AAGGGGACAA GTAGGGAAAA CAGTGACTCC ATCCTGCTAA
7681 ACGGGTGTCG TCGTGCCGTG GACATCCTAT ATGTGGACGA GGCTTTCGCT TGCCATTCCG
7741 GTACTCTGCT GGCCCTAATT GCTCTTGTTA AACCTCGGAG CAAAGTGGTG TTATGCGGAG
7801 ACCCCAAGCA ATGCGGATTC TTCAATATGA TGCAGCTTAA GGTGAACTTC AACCACAACA
7861 TCTGCACTGA AGTATGTCAT AAAAGTATAT CCAGACGTTG CACGCGTCCA GTCACGGCCA
7921 TCGTGTCTAC GTTGCACTAC GGAGGCAAGA TGCGCACGAC CAACCCGTGC AACAAACCCA
7981 TAATCATAGA CACCACAGGA CAGACCAAGC CCAAGCCAGG AGACATCGTG TTAACATGCT
8041 TCCGAGGCTG GGCAAAGCAG CTGCAGTTGG ACTACCGTGG ACACGAAGTC ATGACAGCAG
8101 CAGCATCTCA GGGCCTCACC CGCAAAGGGG TATACGCCGT AAGGCAGAAG GTGAATGAAA
8161 ATCCCTTGTA TGCCCCTGCG TCGGAGCACG TGAATGTACT GCTGACGCGC ACTGAGGATA
8221 GGCTGGTGTG GAAAACGCTG GCCGGCGATC CCTGGATTAA GGTCCTATCA AACATTCCAC
8281 AGGGTAACTT TACGGCCACA TTGGAAGAAT GGCAAGAAGA ACACGACAAA ATAATGAAGG
8341 TGATTGAAGG ACCGGCTGCG CCTGTGGACG CGTTCCAGAA CAAAGCGAAC GTGTGTTGGG
8401 CGAAAAGCCT GGTGCCTGTC CTGGACACTG CCGGAATCAG ATTGACAGCA GAGGAGTGGA
8461 GCACCATAAT TACAGCATTT AAGGAGGACA GAGCTTACTC TCCAGTGGTG GCCTTGAATG
8521 AAATTTGCAC CAAGTACTAT GGAGTTGACC TGGACAGTGG CCTGTTTTCT GCCCCGAAGG
8581 TGTCCCTGTA TTACGAGAAC AACCACTGGG ATAACAGACC TGGTGGAAGG ATGTATGGAT
8641 TCAATGCCGC AACAGCTGCC AGGCTGGAAG CTAGACATAC CTTCCTGAAG GGGCAGTGGC
8701 ATACGGGCAA GCAGGCAGTT ATCGCAGAAA GAAAAATCCA ACCGCTTTCT GTGCTGGACA
8761 ATGTAATTCC TATCAACCGC AGGCTGCCGC ACGCCCTGGT GGCTGAGTAC AAGACGGTTA
8821 AAGGCAGTAG GGTTGAGTGG CTGGTCAATA AAGTAAGAGG GTACCACGTC CTGCTGGTGA
8881 GTGAGTACAA CCTGGCTTTG CCTCGACGCA GGGTCACTTG GTTGTCACCG CTGAATGTCA
8941 CAGGCGCCGA TAGGTGCTAC GACCTAAGTT TAGGACTGCC GGCTGACGCC GGCAGGTTCG
```

FIG.29E

```
 9001 ACTTGGTCTT TGTGAACATT CACACGGAAT TCAGAATCCA CCACTACCAG CAGTGTGTCG
 9061 ACCACGCCAT GAAGCTGCAG ATGCTTGGGG GAGATGCGCT ACGACTGCTA AAACCCGGCG
 9121 GCATCTTGAT GAGAGCTTAC GGATACGCCG ATAAAATCAG CGAAGCCGTT GTTTCCTCCT
 9181 TAAGCAGAAA GTTCTCGTCT GCAAGAGTGT TGCGCCCGGA TTGTGTCACC AGCAATACAG
 9241 AAGTGTTCTT GCTGTTCTCC AACTTTGACA ACGGAAAGAG ACCCTCTACG CTACACCAGA
 9301 TGAATACCAA GCTGAGTGCC GTGTATGCCG GAGAAGCCAT GCACACGGCC GGGTGTGCAC
 9361 CATCCTACAG AGTTAAGAGA GCAGACATAG CCACGTGCAC AGAAGCGGCT GTGGTTAACG
 9421 CAGCTAACGC CCGTGGAACT GTAGGGGATG GCGTATGCAG GGCCGTGGCG AAGAAATGGC
 9481 CGTCAGCCTT TAAGGGAGCA GCAACACCAG TGGGCACAAT TAAAACAGTC ATGTGCGGCT
 9541 CGTACCCCGT CATCCACGCT GTAGCGCCTA ATTTCTCTGC CACGACTGAA GCGGAAGGGG
 9601 ACCGCGAATT GGCCGCTGTC TACCGGGCAG TGGCCGCCGA AGTAAACAGA CTGTCACTGA
 9661 GCAGCGTAGC CATCCCGCTG CTGTCCACAG GAGTGTTCAG CGGCGGAAGA GATAGGCTGC
 9721 AGCAATCCCT CAACCATCTA TTCACAGCAA TGGACGCCAC GGACGCTGAC GTGACCATCT
 9781 ACTGCAGAGA CAAAAGTTGG GAGAAGAAAA TCCAGGAAGC CATTGACATG AGGACGGCTG
 9841 TGGAGTTGCT CAATGATGAC GTGGAGCTGA CCACAGACTT GGTGAGAGTG CACCCGGACA
 9901 GCAGCCTGGT GGGTCGTAAG GGCTACAGTA CCACTGACGG GTCGCTGTAC TCGTACTTTG
 9961 AAGGTACGAA ATTCAACCAG GCTGCTATTG ATATGGCAGA GATACTGACG TTGTGGCCCA
10021 GACTGCAAGA GGCAAACGAA CAGATATGCC TATACGCGCT GGGCGAAACA ATGGACAACA
10081 TCAGATCCAA ATGTCCGGTG AACGATTCCG ATTCATCAAC ACCTCCCAGG ACAGTGCCCT
10141 GCCTGTGCCG CTACGCAATG ACAGCAGAAC GGATCGCCCG CCTTAGGTCA CACCAAGTTA
10201 AAAGCATGGT GGTTTGCTCA TCTTTTCCCC TCCCGAAATA CCATGTAGAT GGGGTGCAGA
10261 AGGTAAAGTG CGAGAAGGTT CTCCTGTTCG ACCCGACGGT ACCTTCAGTG GTTAGTCCGC
10321 GGAAGTATGC CGCATCTACG ACGGACCACT CAGATCGGTC GTTACGAGGG TTTGACTTGG
10381 ACTGGACCAC CGACTCGTCT TCCACTGCCA GCGATACCAT GTCGCTACCC AGTTTGCAGT
10441 CGTGTGACAT CGACTCGATC TACGAGCCAA TGGCTCCCAT AGTAGTGACG GCTGACGTAC
10501 ACCCTGAACC CGCAGGCATC GCGGACCTGG CGGCAGATGT GCACCCTGAA CCCGCAGACC
10561 ATGTGGACCT GGAGAACCCG ATTCCTCCAC CGCGCCCGAA GAGAGCTGCA TACCTTGCCT
10621 CCCGCGCGGC GGAGCGACCG GTGCCGGCGC CGAGAAAGCC GACGCCTGCC CCAAGGACTG
10681 CGTTTAGGAA CAAGCTGCCT TTGACGTTCG GCGACTTTGA CGAGCACGAG GTCGATGCGT
10741 TGGCCTCCGG GATTACTTTC GGAGACTTCG ACGACGTCCT GCGACTAGGC CGCGCGGGTG
10801 CATATATTTT CTCCTCGGAC ACTGGCAGCG GACATTTACA ACAAAAATCC GTTAGGCAGC
10861 ACAATCTCCA GTGCGCACAA CTGGATGCGG TCCAGGAGGA GAAAATGTAC CCGCCAAAAT
10921 TGGATACTGA GAGGGAGAAG CTGTTGCTGC TGAAAATGCA GATGCACCCA TCGGAGGCTA
10981 ATAAGAGTCG ATACCAGTCT CGCAAAGTGG AGAACATGAA AGCCACGGTG GTGGACAGGC
11041 TCACATCGGG GGCCAGATTG TACACGGGAG CGGACGTAGG CCGCATACCA ACATACGCGG
11101 TTCGGTACCC CCGCCCCGTG TACTCCCCTA CCGTGATCGA AGATTCTCA AGCCCCGATG
11161 TAGCAATCGC AGCGTGCAAC GAATACCTAT CCAGAAATTA CCCAACAGTG GCGTCGTACC
11221 AGATAACAGA TGAATACGAC GCATACTTGG ACATGGTTGA CGGGTCGGAT AGTTGCTTGG
11281 ACAGAGCGAC ATTCTGCCCG GCGAAGCTCC GGTGCTACCC GAAACATCAT GCGTACCACC
11341 AGCCGACTGT ACGCAGTGCC GTCCCGTCAC CCTTTCAGAA CACACTACAG AACGTGCTAG
11401 CGGCTGCCAC CAAGAGAAAC TGCAACGTCA CGCAAATGCG AGAACTACCC ACCATGGACT
```

FIG. 29F

```
11461 CGGCAGTGTT CAACGTGGAG TGCTTCAAGC GCTATGCCTG CTCCGGAGAA TATTGGGAAG
11521 AATATGCTAA ACAACCTATC CGGATAACCA CTGAGAACAT CACTACCTAT GTGACCAAAT
11581 TGAAAGGCCC GAAAGCTGCT GCCTTGTTCG CTAAGACCCA CAACTTGGTT CCGCTGCAGG
11641 AGGTTCCCAT GGACAGATTC ACGGTCGACA TGAAACGAGA TGTCAAAGTC ACTCCAGGGA
11701 CGAAACACAC AGAGGAAAGA CCCAAAGTCC AGGTAATTCA AGCAGCGGAG CCATTGGCGA
11761 CCGCTTACCT GTGCGGCATC CACAGGGAAT TAGTAAGGAG ACTAAATGCT GTGTTACGCC
11821 CTAACGTGCA CACATTGTTT GATATGTCGG CCGAAGACTT TGACGCGATC ATCGCCTCTC
11881 ACTTCCACCC AGGAGACCCG GTTCTAGAGA CGGACATTGC ATCATTCGAC AAAAGCCAGG
11941 ACGACTCCTT GGCTCTTACA GGTTTAATGA TCCTCGAAGA TCTAGGGGTG GATCAGTACC
12001 TGCTGGACTT GATCGAGGCA GCCTTTGGGG AAATATCCAG CTGTCACCTA CCAACTGGCA
12061 CGCGCTTCAA GTTCGGAGCT ATGATGAAAT CGGGCATGTT TCTGACTTTG TTTATTAACA
12121 CTGTTTTGAA CATCACCATA GCAAGCAGGG TACTGGAGCA GAGACTCACT GACTCCGCCT
12181 GTGCGGCCTT CATCGGCGAC GACAACATCG TTCACGGAGT GATCTCCGAC AAGCTGATGG
12241 CGGAGAGGTG CGCGTCGTGG GTCAACATGG AGGTGAAGAT CATTGACGCT GTCATGGGCG
12301 AAAAACCCCC ATATTTTTGT GGGGGATTCA TAGTTTTTGA CAGCGTCACA CAGACCGCCT
12361 GCCGTGTTTC AGACCCACTT AAGCGCCTGT TCAAGTTGGG TAAGCCGCTA ACAGCTGAAG
12421 ACAAGCAGGA CGAAGACAGG CGACGAGCAC TGAGTGACGA GGTT
```

FIG.29G pDEST10 6708 bp

| Location (Base Nos.) | Gene Encoded |
|---|---|
| 23..152 | Ppolh |
| 461..337 | attR1 |
| 711..1370 | CmR |
| 1490..1574 | inactivated ccdA |
| 1712..2017 | ccdB |
| 2058..2182 | attR2 |
| 3394..4369 | ampR |
| 4510..5164 | ori |
| 5658..62 | genR |

```
   1 CCCCGGATGA AGTGGTTCGC ATCCTCGGTT TTCTGGAAGG CGAGCATCGT TTGTTCGCCC
  61 AGGACTCTAG CTATAGTTCT AGTGGTTGGC TACGTATACT CCGGAATATT AATAGATCAT
 121 GGAGATAATT AAAATGATAA CCATCTCGCA AATAAATAAG TATTTTACTG TTTTCGTAAC
 181 AGTTTTGTAA TAAAAAAACC TATAAATATT CCGGATTATT CATACCGTCC CACCATCGGG
 241 CGCGGATCTC GGTCCGAAAC CATGTCGTAC TACCATCACC ATCACCATCA CGATTACGAT
 301 ATCCCAACGA CCGAAAACCT GTATTTTCAG GGCATCACAA GTTTGTACAA AAAAGCTGAA
 361 CGAGAAACGT AAAATGATAT AAATATCAAT ATATTAAATT AGATTTTGCA TAAAAAACAG
 421 ACTACATAAT ACTGTAAAAC ACAACATATC CAGTCACTAT GGCGGCCGCT AAGTTGGCAG
 481 CATCACCCGA CGCACTTTGC GCCGAATAAA TACCTGTGAC GGAAGATCAC TTCGCAGAAT
 541 AAATAAATCC TGGTGTCCCT GTTGATACCG GGAAGCCCTG GGCCAACTTT TGGCGAAAAT
 601 GAGACGTTGA TCGGCACGTA AGAGGTTCCA ACTTTCACCA TAATGAAATA AGATCACTAC
 661 CGGGCGTATT TTTTGAGTTA TCGAGATTTT CAGGAGCTAA GGAAGCTAAA ATGGAGAAAA
 721 AAATCACTGG ATATACCACC GTTGATATAT CCCAATGGCA TCGTAAAGAA CATTTTGAGG
 781 CATTTCAGTC AGTTGCTCAA TGTACCTATA ACCAGACCGT TCAGCTGGAT ATTACGGCCT
 841 TTTTAAAGAC CGTAAAGAAA AATAAGCACA AGTTTTATCC GGCCTTTATT CACATTCTTG
 901 CCCGCCTGAT GAATGCTCAT CCGGAATTCC GTATGGCAAT GAAAGACGGG GAGCTGGTGA
 961 TATGGGATAG TGTTCACCCT TGTTACACCG TTTTCCATGA GCAAACTGAA ACGTTTTCAT
1021 CGCTCTGGAG TGAATACCAC GACGATTTCC GGCAGTTTCT ACACATATAT TCGCAAGATG
1081 TGGCGTGTTA CGGTGAAAAC CTGGCCTATT TCCCTAAAGG GTTTATTGAG AATATGTTTT
1141 TCGTCTCAGC CAATCCCTGG GTGAGTTTCA CCAGTTTTGA TTTAAACGTG GCCAATATGG
1201 ACAACTTCTT CGCCCCCGTT TTCACCATGG GCAAATATTA TACGCAAGGC GACAAGGTGC
1261 TGATGCCGCT GGCGATTCAG GTTCATCATG CCGTCTGTGA TGGCTTCCAT GTCGGCAGAA
1321 TGCTTAATGA ATTACAACAG TACTGCGATG AGTGGCAGGG CGGGGCGTAA ACGCGTGGAT
1381 CCGGCTTACT AAAAGCCAGA TAACAGTATG CGTATTTGCG CGCTGATTTT TGCGGTATAA
1441 GAATATATAC TGATATGTAT ACCCGAAGTA TGTCAAAAAG AGGTGTGCTA TGAAGCAGCG
1501 TATTACAGTG ACAGTTGACA GCGACAGCTA TCAGTTGCTC AAGGCATATA TGATGTCAAT
1561 ATCTCCGGTC TGGTAAGCAC AACCATGCAG AATGAAGCCC GTCGTCTGCG TGCCGAACGC
1621 TGGAAAGCGG AAAATCAGGA AGGGATGGCT GAGGTCGCCC GGTTTATTGA AATGAACGGC
1681 TCTTTTGCTG ACGAGAACAG GGACTGGTGA AATGCAGTTT AAGGTTTACA CCTATAAAAG
1741 AGAGAGCCGT TATCGTCTGT TTGTGGATGT ACAGAGTGAT ATTATTGACA CGCCCGGGCG
```

FIG.30B

```
1801 ACGGATGGTG ATCCCCCTGG CCAGTGCACG TCTGCTGTCA GATAAAGTCT CCCGTGAACT
1861 TTACCCGGTG GTGCATATCG GGGATGAAAG CTGGCGCATG ATGACCACCG ATATGGCCAG
1921 TGTGCCGGTC TCCGTTATCG GGGAAGAAGT GGCTGATCTC AGCCACCGCG AAAATGACAT
1981 CAAAAACGCC ATTAACCTGA TGTTCTGGGG AATATAAATG TCAGGCTCCC TTATACACAG
2041 CCAGTCTGCA GGTCGACCAT AGTGACTGGA TATGTTGTGT TTTACAGTAT TATGTAGTCT
2101 GTTTTTTATG CAAAATCTAA TTTAATATAT TGATATTTAT ATCATTTTAC GTTTCTCGTT
2161 CAGCTTTCTT GTACAAAGTG GTGATGCCAT GGATCCGGAA TTCAAAGGCC TACGTCGACG
2221 AGCTCAACTA GTGCGGCCGC TTTCGAATCT AGAGCCTGCA GTCTCGAGGC ATGCGGTACC
2281 AAGCTTGTCG AGAAGTACTA GAGGATCATA ATCAGCCATA CCACATTTGT AGAGGTTTTA
2341 CTTGCTTTAA AAAACCTCCC ACACCTCCCC CTGAACCTGA AACATAAAAT GAATGCAATT
2401 GTTGTTGTTA ACTTGTTTAT TGCAGCTTAT AATGGTTACA AATAAAGCAA TAGCATCACA
2461 AATTTCACAA ATAAAGCATT TTTTTCACTG CATTCTAGTT GTGGTTTGTC CAAACTCATC
2521 AATGTATCTT ATCATGTCTG GATCTGATCA CTGCTTGAGC CTAGGAGATC CGAACCAGAT
2581 AAGTGAAATC TAGTTCCAAA CTATTTTGTC ATTTTTAATT TTCGTATTAG CTTACGACGC
2641 TACACCCAGT TCCCATCTAT TTTGTCACTC TTCCCTAAAT AATCCTTAAA AACTCCATTT
2701 CCACCCCTCC CAGTTCCCAA CTATTTTGTC CGCCCACAGC GGGGCATTTT TCTTCCTGTT
2761 ATGTTTTTAA TCAAACATCC TGCCAACTCC ATGTGACAAA CCGTCATCTT CGGCTACTTT
2821 TTCTCTGTCA CAGAATGAAA ATTTTTCTGT CATCTCTTCG TTATTAATGT TTGTAATTGA
2881 CTGAATATCA ACGCTTATTT GCAGCCTGAA TGGCGAATGG GACGCGCCCT GTAGCGGCGC
2941 ATTAAGCGCG GCGGGTGTGG TGGTTACGCG CAGCGTGACC GCTACACTTG CCAGCGCCCT
3001 AGCGCCCGCT CCTTTCGCTT TCTTCCCTTC CTTTCTCGCC ACGTTCGCCG GCTTTCCCCG
3061 TCAAGCTCTA AATCGGGGGC TCCCTTTAGG GTTCCGATTT AGTGCTTTAC GGCACCTCGA
3121 CCCCAAAAAA CTTGATTAGG GTGATGGTTC ACGTAGTGGG CCATCGCCCT GATAGACGGT
3181 TTTTCGCCCT TTGACGTTGG AGTCCACGTT CTTTAATAGT GGACTCTTGT TCCAAACTGG
3241 AACAACACTC AACCCTATCT CGGTCTATTC TTTTGATTTA TAAGGGATTT TGCCGATTTC
3301 GGCCTATTGG TTAAAAAATG AGCTGATTTA ACAAAAATTT AACGCGAATT TTAACAAAAT
3361 ATTAACGTTT ACAATTTCAG GTGGCACTTT TCGGGGAAAT GTGCGCGGAA CCCCTATTTG
3421 TTTATTTTTC TAAATACATT CAAATATGTA TCCGCTCATG AGACAATAAC CCTGATAAAT
3481 GCTTCAATAA TATTGAAAAA GGAAGAGTAT GAGTATTCAA CATTTCCGTG TCGCCCTTAT
3541 TCCCTTTTTT GCGGCATTTT GCCTTCCTGT TTTTGCTCAC CCAGAAACGC TGGTGAAAGT
3601 AAAAGATGCT GAAGATCAGT TGGGTGCACG AGTGGGTTAC ATCGAACTGG ATCTCAACAG
3661 CGGTAAGATC CTTGAGAGTT TTCGCCCCGA AGAACGTTTT CCAATGATGA GCACTTTTAA
3721 AGTTCTGCTA TGTGGCGCGG TATTATCCCG TATTGACGCC GGGCAAGAGC AACTCGGTCG
3781 CCGCATACAC TATTCTCAGA ATGACTTGGT TGAGTACTCA CCAGTCACAG AAAAGCATCT
3841 TACGGATGGC ATGACAGTAA GAGAATTATG CAGTGCTGCC ATAACCATGA GTGATAACAC
3901 TGCGGCCAAC TTACTTCTGA CAACGATCGG AGGACCGAAG GAGCTAACCG CTTTTTTGCA
3961 CAACATGGGG GATCATGTAA CTCGCCTTGA TCGTTGGGAA CCGGAGCTGA ATGAAGCCAT
4021 ACCAAACGAC GAGCGTGACA CCACGATGCC TGTAGCAATG GCAACAACGT TGCGCAAACT
4081 ATTAACTGGC GAACTACTTA CTCTAGCTTC CCGGCAACAA TTAATAGACT GGATGGAGGC
4141 GGATAAAGTT GCAGGACCAC TTCTGCGCTC GGCCCTTCCG GCTGGCTGGT TTATTGCTGA
4201 TAAATCTGGA GCCGGTGAGC GTGGGTCTCG CGGTATCATT GCAGCACTGG GGCCAGATGG
```

FIG.30C

```
4261 TAAGCCCTCC CGTATCGTAG TTATCTACAC GACGGGGAGT CAGGCAACTA TGGATGAACG
4321 AAATAGACAG ATCGCTGAGA TAGGTGCCTC ACTGATTAAG CATTGGTAAC TGTCAGACCA
4381 AGTTTACTCA TATATACTTT AGATTGATTT AAAACTTCAT TTTTAATTTA AAAGGATCTA
4441 GGTGAAGATC CTTTTTGATA ATCTCATGAC CAAAATCCCT TAACGTGAGT TTTCGTTCCA
4501 CTGAGCGTCA GACCCCGTAG AAAAGATCAA AGGATCTTCT TGAGATCCTT TTTTTCTGCG
4561 CGTAATCTGC TGCTTGCAAA CAAAAAAACC ACCGCTACCA GCGGTGGTTT GTTTGCCGGA
4621 TCAAGAGCTA CCAACTCTTT TTCCGAAGGT AACTGGCTTC AGCAGAGCGC AGATACCAAA
4681 TACTGTCCTT CTAGTGTAGC CGTAGTTAGG CCACCACTTC AAGAACTCTG TAGCACCGCC
4741 TACATACCTC GCTCTGCTAA TCCTGTTACC AGTGGCTGCT GCCAGTGGCG ATAAGTCGTG
4801 TCTTACCGGG TTGGACTCAA GACGATAGTT ACCGGATAAG GCGCAGCGGT CGGGCTGAAC
4861 GGGGGGTTCG TGCACACAGC CCAGCTTGGA GCGAACGACC TACACCGAAC TGAGATACCT
4921 ACAGCGTGAG CATTGAGAAA GCGCCACGCT TCCCGAAGGG AGAAAGGCGG ACAGGTATCC
4981 GGTAAGCGGC AGGGTCGGAA CAGGAGAGCG CACGAGGGAG CTTCCAGGGG GAAACGCCTG
5041 GTATCTTTAT AGTCCTGTCG GGTTTCGCCA CCTCTGACTT GAGCGTCGAT TTTTGTGATG
5101 CTCGTCAGGG GGGCGGAGCC TATGGAAAAA CGCCAGCAAC GCGGCCTTTT TACGGTTCCT
5161 GGCCTTTTGC TGGCCTTTTG CTCACATGTT CTTTCCTGCG TTATCCCCTG ATTCTGTGGA
5221 TAACCGTATT ACCGCCTTTG AGTGAGCTGA TACCGCTCGC CGCAGCCGAA CGACCGAGCG
5281 CAGCGAGTCA GTGAGCGAGG AAGCGGAAGA GCGCCTGATG CGGTATTTTC TCCTTACGCA
5341 TCTGTGCGGT ATTTCACACC GCAGACCAGC CGCGTAACCT GGCAAAATCG GTTACGGTTG
5401 AGTAATAAAT GGATGCCCTG CGTAAGCGGG TGTGGGCGGA CAATAAAGTC TTAAACTGAA
5461 CAAAATAGAT CTAAACTATG ACAATAAAGT CTTAAACTAG ACAGAATAGT TGTAAACTGA
5521 AATCAGTCCA GTTATGCTGT GAAAAAGCAT ACTGGACTTT TGTTATGGCT AAAGCAAACT
5581 CTTCATTTTC TGAAGTGCAA ATTGCCCGTC GTATTAAAGA GGGGCGTGGC CAAGGGCATG
5641 GTAAAGACTA TATTCGCGGC GTTGTGACAA TTTACCGAAC AACTCCGCGG CCGGGAAGCC
5701 GATCTCGGCT TGAACGAATT GTTAGGTGGC GGTACTTGGG TCGATATCAA AGTGCATCAC
5761 TTCTTCCCGT ATGCCCAACT TTGTATAGAG AGCCACTGCG GATCGTCAC CGTAATCTGC
5821 TTGCACGTAG ATCACATAAG CACCAAGCGC GTTGGCCTCA TGCTTGAGGA GATTGATGAG
5881 CGCGGTGGCA ATGCCCTGCC TCCGGTGCTC GCCGGAGACT GCGAGATCAT AGATATAGAT
5941 CTCACTACGC GGCTGCTCAA ACCTGGGCAG AACGTAAGCC GCGAGAGCGC CAACAACCGC
6001 TTCTTGGTCG AAGGCAGCAA GCGCGATGAA TGTCTTACTA CGGAGCAAGT TCCCGAGGTA
6061 ATCGGAGTCC GGCTGATGTT GGGAGTAGGT GGCTACGTCT CCGAACTCAC GACCGAAAAG
6121 ATCAAGAGCA GCCCGCATGG ATTTGACTTG GTCAGGGCCG AGCCTACATG TGCGAATGAT
6181 GCCCATACTT GAGCCACCTA ACTTTGTTTT AGGGCGACTG CCCTGCTGCG TAACATCGTT
6241 GCTGCTGCGT AACATCGTTG CTGCTCCATA ACATCAAACA TCGACCCACG GCGTAACGCG
6301 CTTGCTGCTT GGATGCCCGA GGCATAGACT GTACAAAAAA ACAGTCATAA CAAGCCATGA
6361 AAACCGCCAC TGCGCCGTTA CCACCGCTGC GTTCGGTCAA GGTTCTGGAC CAGTTGCGTG
6421 AGCGCATACG CTACTTGCAT TACAGTTTAC GAACCGAACA GGCTTATGTC AACTGGGTTC
6481 GTGCCTTCAT CCGTTTCCAC GGTGTGCGTC ACCCGGCAAC CTTGGGCAGC AGCGAAGTCG
6541 AGGCATTTCT GTCCTGGCTG GCGAACGAGC GCAAGGTTTC GGTCTCCACG CATCGTCAGG
6601 CATTGGCGGC CTTGCTGTTC TTCTACGGCA AGGTGCTGTG CACGGATCTG CCCTGGCTTC
6661 AGGAGATCGG AAGACCTCGG CCGTCGCGGC GCTTGCCGGT GGTGCTGA
```

FIG.30D

TET-REGULATED EUKARYOTIC EXPRESSION mRNA FROM CMV PROMOTER (CONTROLLED by TETRACYCLINE)

358 tag tga acc gtc aga tcg cct gga gac gcc atc cac gct gtt ttg acc tcc
    atc act tgg cag tct agc gga cct ctg cgg tag gtg cga caa aac tgg agg 409 ata gaa gac acc ggg acc gat cca gcc tcc gcg gcc ccg aat tcg agc tcg
    tat ctt ctg tgg ccc tgg cta ggt cgg agg cgc cgg ggc tta agc tcg agc Sal         Cla    Hind3    EcoRV
460 gta ccc ggg gat cct cta gag tcg agg tcg acg gta tcg ata agc ttg atb
    cat ggg ccc cta gga gat ctc agc tcc agc tgc cat agc tat tcg aac tat Int     attR1
511 tca aca agt ttg tac aaa aaa gct gaa cga gaa acg taa aat gat ata cat
    agt tgt tca aac atg ttt ttt cga ctt gct ctt tgc att tta cta tat ata

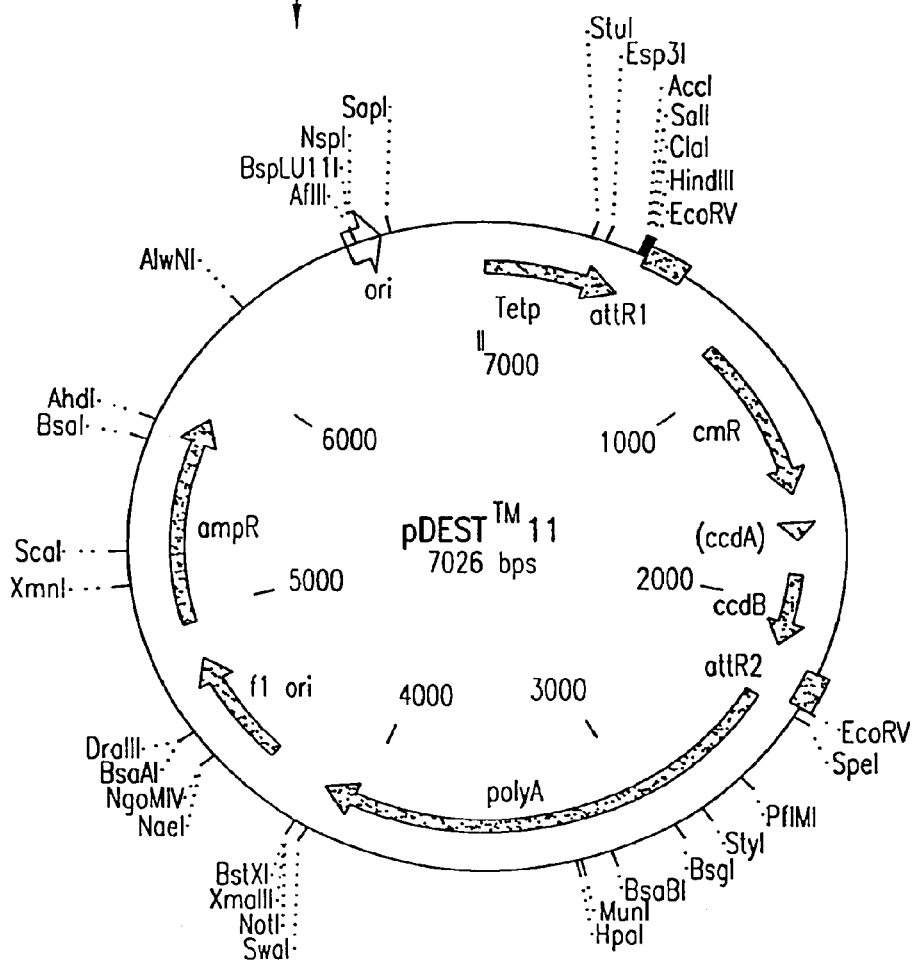

FIG.31A pDEST11 7026 bp

| Location (Base Nos.) | Gene Encoded |
|---|---|
| 4..479 | Tetp ((Tet operator)7 and min hCMV promoter) |
| 638..514 | attR1 |
| 888..1547 | CmR |
| 1667..1751 | inactivated ccdA |
| 1889..2194 | ccdB |
| 2235..2359 | attR2 |
| 2402..4132 | polyA |
| 4347..4803 | f1 ori |
| 4940..5797 | ampR |

```
   1 CGAGTTTACC ACTCCCTATC AGTGATAGAG AAAAGTGAAA GTCGAGTTTA CCACTCCCTA
  61 TCAGTGATAG AGAAAAGTGA AAGTCGAGTT TACCACTCCC TATCAGTGAT AGAGAAAAGT
 121 GAAAGTCGAG TTTACCACTC CCTATCAGTG ATAGAGAAAA GTGAAAGTCG AGTTTACCAC
 181 TCCCTATCAG TGATAGAGAA AAGTGAAAGT CGAGTTTACC ACTCCCTATC AGTGATAGAG
 241 AAAAGTGAAA GTCGAGTTTA CCACTCCCTA TCAGTGATAG AGAAAAGTGA AAGTCGAGCT
 301 CGGTACCCGG GTCGAGTAGG CGTGTACGGT GGGAGGCCTA TATAAGCAGA GCTCGTTTAG
 361 TGAACCGTCA GATCGCCTGG AGACGCCATC CACGCTGTTT TGACCTCCAT AGAAGACACC
 421 GGGACCGATC CAGCCTCCGC GGCCCCGAAT TCGAGCTCGG TACCCGGGGA TCCTCTAGAG
 481 TCGAGGTCGA CGGTATCGAT AAGCTTGATA TCAACAAGTT TGTACAAAAA AGCTGAACGA
 541 GAAACGTAAA ATGATATAAA TATCAATATA TTAAATTAGA TTTTGCATAA AAAACAGACT
 601 ACATAATACT GTAAAACACA ACATATCCAG TCACTATGGC GGCCGCTAAG TTGGCAGCAT
 661 CACCCGACGC ACTTTGCGCC GAATAAATAC CTGTGACGGA AGATCACTTC GCAGAATAAA
 721 TAAATCCTGG TGTCCCTGTT GATACCGGGA AGCCCTGGGC CAACTTTTGG CGAAAATGAG
 781 ACGTTGATCG GCACGTAAGA GGTTCCAACT TTCACCATAA TGAAATAAGA TCACTACCGG
 841 GCGTATTTTT TGAGTTATCG AGATTTTCAG GAGCTAAGGA AGCTAAAATG GAGAAAAAAA
 901 TCACTGGATA TACCACCGTT GATATATCCC AATGGCATCG TAAAGAACAT TTTGAGGCAT
 961 TTCAGTCAGT TGCTCAATGT ACCTATAACC AGACCGTTCA GCTGGATATT ACGGCCTTTT
1021 TAAAGACCGT AAAGAAAAAT AAGCACAAGT TTTATCCGGC CTTTATTCAC ATTCTTGCCC
1081 GCCTGATGAA TGCTCATCCG GAATTCCGTA TGGCAATGAA AGACGGTGAG CTGGTGATAT
1141 GGGATAGTGT TCACCCTTGT TACACCGTTT TCCATGAGCA AACTGAAACG TTTTCATCGC
1201 TCTGGAGTGA ATACCACGAC GATTTCCGGC AGTTTCTACA CATATATTCG CAAGATGTGG
1261 CGTGTTACGG TGAAAACCTG GCCTATTTCC CTAAAGGGTT TATTGAGAAT ATGTTTTTCG
1321 TCTCAGCCAA TCCCTGGGTG AGTTTCACCA GTTTTGATTT AAACGTGGCC AATATGGACA
1381 ACTTCTTCGC CCCCGTTTTC ACCATGGGCA AATATTATAC GCAAGGCGAC AAGGTGCTGA
1441 TGCCGCTGGC GATTCAGGTT CATCATGCCG TCTGTGATGG CTTCCATGTC GGCAGAATGC
1501 TTAATGAATT ACAACAGTAC TGCGATGAGT GGCAGGGCGG GGCGTAAAGA TCTGGATCCG
1561 GCTTACTAAA AGCCAGATAA CAGTATGCGT ATTTGCGCGC TGATTTTTGC GGTATAAGAA
```

```
1621 TATATACTGA TATGTATACC CGAAGTATGT CAAAAAGAGG TGTGCTATGA AGCAGCGTAT
1681 TACAGTGACA GTTGACAGCG ACAGCTATCA GTTGCTCAAG GCATATATGA TGTCAATATC
1741 TCCGGTCTGG TAAGCACAAC CATGCAGAAT GAAGCCCGTC GTCTGCGTGC CGAACGCTGG
1801 AAAGCGGAAA ATCAGGAAGG GATGGCTGAG GTCGCCCGGT TTATTGAAAT GAACGGCTCT
1861 TTTGCTGACG AGAACAGGGA CTGGTGAAAT GCAGTTTAAG GTTTACACCT ATAAAAGAGA
1921 GAGCCGTTAT CGTCTGTTTG TGGATGTACA GAGTGATATT ATTGACACGC CCGGGCGACG
1981 GATGGTGATC CCCCTGGCCA GTGCACGTCT GCTGTCAGAT AAAGTCTCCC GTGAACTTTA
2041 CCCGGTGGTG CATATCGGGG ATGAAAGCTG GCGCATGATG ACCACCGATA TGGCCAGTGT
2101 GCCGGTCTCC GTTATCGGGG AAGAAGTGGC TGATCTCAGC CACCGCGAAA ATGACATCAA
2161 AAACGCCATT AACCTGATGT TCTGGGGAAT ATAAATGTCA GGCTCCCTTA TACACAGCCA
2221 GTCTGCAGGT CGACCATAGT GACTGGATAT GTTGTGTTTT ACAGTATTAT GTAGTCTGTT
2281 TTTTATGCAA AATCTAATTT AATATATTGA TATTTATATC ATTTTACGTT TCTCGTTCAG
2341 CTTTCTTGTA CAAAGTGGTT GATATCGAAT TCCTGCAGCC CGGGGGATCC ACTAGTTCTA
2401 GAGCACTGCG ATGAGTGGCA GGGCGGGGCG TAATTTTTTT AAGGCAGTTA TTGGTGCCCT
2461 TAAACGCCTG GTGCTACGCC TGAATAAGTG ATAATAAGCG GATGAATGGC AGAAATTCGC
2521 CGGATCTTTG TGAAGGAACC TTACTTCTGT GGTGTGACAT AATTGGACAA ACTACCTACA
2581 GAGATTTAAA GCTCTAAGGT AAATATAAAA TTTTTAAGTG TATAATGTGT TAAACTACTG
2641 ATTCTAATTG TTTGTGTATT TTAGATTCCA ACCTATGGAA CTGATGAATG GGAGCAGTGG
2701 TGGAATGCCT TTAATGAGGA AAACCTGTTT TGCTCAGAAG AAATGCCATC TAGTGATGAT
2761 GAGGCTACTG CTGACTCTCA ACATTCTACT CCTCCAAAAA AGAAGAGAAA GGTAGAAGAC
2821 CCCAAGGACT TTCCTTCAGA ATTGCTAAGT TTTTTGAGTC ATGCTGTGTT TAGTAATAGA
2881 ACTCTTGCTT GCTTTGCTAT TTACACCACA AAGGAAAAAG CTGCACTGCT ATACAAGAAA
2941 ATTATGGAAA AATATTCTGT AACCTTTATA AGTAGGCATA ACAGTTATAA TCATAACATA
3001 CTGTTTTTTC TTACTCCACA CAGGCATAGA GTGTCTGCTA TTAATAACTA TGCTCAAAAA
3061 TTGTGTACCT TTAGCTTTTT AATTTGTAAA GGGGTTAATA AGGAATATTT GATGTATAGT
3121 GCCTTGACTA GAGATCATAA TCAGCCATAC CACATTTGTA GAGGTTTTAC TTGCTTTAAA
3181 AAACCTCCCA CACCTCCCCC TGAACCTGAA ACATAAAATG AATGCAATTG TTGTTGTTAA
3241 CTTGTTTATT GCAGCTTATA ATGGTTACAA ATAAAGCAAT AGCATCACAA ATTTCACAAA
3301 TAAAGCATTT TTTTCACTGC ATTCTAGTTG TGGTTTGTCC AAACTCATCA ATGTATCTTA
3361 TCATGTCTGG ATCCCCAGGA AGCTCCTCTG TGTCCTCATA AACCCTAACC TCCTCTACTT
3421 GAGAGGACAT TCCAATCATA GGCTGCCCAT CCACCCTCTG TGTCCTCCTG TTAATTAGGT
3481 CACTTAACAA AAAGGAAATT GGGTAGGGGT TTTTCACAGA CCGCTTTCTA AGGGTAATTT
3541 TAAAATATCT GGGAAGTCCC TTCCACTGCT GTGTTCCAGA AGTGTTGGTA AACAGCCCAC
3601 AAATGTCAAC AGCAGAAACA TACAAGCTGT CAGCTTTGCA CAAGGGCCCA ACACCCTGCT
3661 CATCAAGAAG CACTGTGGTT GCTGTGTTAG TAATGTGCAA AACAGGAGGC ACATTTTCCC
3721 CACCTGTGTA GGTTCCAAAA TATCTAGTGT TTTCATTTTT ACTTGGATCA GGAACCCAGC
3781 ACTCCACTGG ATAAGCATTA TCCTTATCCA AAACAGCCTT GTGGTCAGTG TTCATCTGCT
3841 GACTGTCAAC TGTAGCATTT TTTGGGGTTA CAGTTTGAGC AGGATATTTG GTCCTGTAGT
```

FIG.31C

```
3901 TTGCTAACAC ACCCTGCAGC TCCAAAGGTT CCCCACCAAC AGCAAAAAAA TGAAAATTTG
3961 ACCCTTGAAT GGGTTTTCCA GCACCATTTT CATGAGTTTT TTGTGTCCCT GAATGCAAGT
4021 TTAACATAGC AGTTACCCCA ATAACCTCAG TTTTAACAGT AACAGCTTCC CACATCAAAA
4081 TATTTCCACA GGTTAAGTCC TCATTTAAAT TAGGCAAAGG AATTGCTCTA GAGCGGCCGC
4141 CACCGCGGTG GAGCTCCAAT TCGCCCTATA GTGAGTCGTA TTACGCGCGC TCACTGGCCG
4201 TCGTTTTACA ACGTCGTGAC TGGGAAAACC CTGGCGTTAC CCAACTTAAT CGCCTTGCAG
4261 CACATCCCCC TTTCGCCAGC TGGCGTAATA GCGAAGAGGC CCGCACCGAT CGCCCTTCCC
4321 AACAGTTGCG CAGCCTGAAT GGCGAATGGG ACGCGCCCTG TAGCGGCGCA TTAAGCGCGG
4381 CGGGTGTGGT GGTTACGCGC AGCGTGACCG CTACACTTGC CAGCGCCCTA GCGCCCGCTC
4441 CTTTCGCTTT CTTCCCTTCC TTTCTCGCCA CGTTCGCCGG CTTTCCCCGT CAAGCTCTAA
4501 ATCGGGGGCT CCCTTTAGGG TTCCGATTTA GTGCTTTACG GCACCTCGAC CCCAAAAAAC
4561 TTGATTAGGG TGATGGTTCA CGTAGTGGGC CATCGCCCTG ATAGACGGTT TTTCGCCCTT
4621 TGACGTTGGA GTCCACGTTC TTTAATAGTG GACTCTTGTT CCAAACTGGA ACAACACTCA
4681 ACCCTATCTC GGTCTATTCT TTTGATTTAT AAGGGATTTT GCCGATTTCG GCCTATTGGT
4741 TAAAAAATGA GCTGATTTAA CAAAAATTTA ACGCGAATTT TAACAAAATA TTAACGCTTA
4801 CAATTTAGGT GGCACTTTTC GGGGAAATGT GCGCGGAACC CCTATTTGTT TATTTTTCTA
4861 AATACATTCA AATATGTATC CGCTCATGAG ACAATAACCC TGATAAATGC TTCAATAATA
4921 TTGAAAAAGG AAGAGTATGA GTATTCAACA TTTCCGTGTC GCCCTTATTC CCTTTTTTGC
4981 GGCATTTTGC CTTCCTGTTT TTGCTCACCC AGAAACGCTG GTGAAAGTAA AAGATGCTGA
5041 AGATCAGTTG GGTGCACGAG TGGGTTACAT CGAACTGGAT CTCAACAGCG GTAAGATCCT
5101 TGAGAGTTTT CGCCCCGAAG AACGTTTTCC AATGATGAGC ACTTTTAAAG TTCTGCTATG
5161 TGGCGCGGTA TTATCCCGTA TTGACGCCGG GCAAGAGCAA CTCGGTCGCC GCATACACTA
5221 TTCTCAGAAT GACTTGGTTG AGTACTCACC AGTCACAGAA AAGCATCTTA CGGATGGCAT
5281 GACAGTAAGA GAATTATGCA GTGCTGCCAT AACCATGAGT GATAACACTG CGGCCAACTT
5341 ACTTCTGACA ACGATCGGAG GACCGAAGGA GCTAACCGCT TTTTTGCACA ACATGGGGGA
5401 TCATGTAACT CGCCTTGATC GTTGGGAACC GGAGCTGAAT GAAGCCATAC CAAACGACGA
5461 GCGTGACACC ACGATGCCTG TAGCAATGGC AACAACGTTG CGCAAACTAT TAACTGGCGA
5521 ACTACTTACT CTAGCTTCCC GGCAACAATT AATAGACTGG ATGGAGGCGG ATAAAGTTGC
5581 AGGACCACTT CTGCGCTCGG CCCTTCCGGC TGGCTGGTTT ATTGCTGATA AATCTGGAGC
5641 CGGTGAGCGT GGGTCTCGCG GTATCATTGC AGCACTGGGG CCAGATGGTA AGCCCTCCCG
5701 TATCGTAGTT ATCTACACGA CGGGGAGTCA GGCAACTATG GATGAACGAA ATAGACAGAT
5761 CGCTGAGATA GGTGCCTCAC TGATTAAGCA TTGGTAACTG TCAGACCAAG TTTACTCATA
5821 TATACTTTAG ATTGATTTAA AACTTCATTT TTAATTTAAA AGGATCTAGG TGAAGATCCT
5881 TTTTGATAAT CTCATGACCA AAATCCCTTA ACGTGAGTTT TCGTTCCACT GAGCGTCAGA
5941 CCCCGTAGAA AAGATCAAAG GATCTTCTTG AGATCCTTTT TTTCTGCGCG TAATCTGCTG
6001 CTTGCAAACA AAAAAACCAC CGCTACCAGC GGTGGTTTGT TTGCCGGATC AAGAGCTACC
6061 AACTCTTTTT CCGAAGGTAA CTGGCTTCAG CAGAGCGCAG ATACCAAATA CTGTCCTTCT
6121 AGTGTAGCCG TAGTTAGGCC ACCACTTCAA GAACTCTGTA GCACCGCCTA CATACCTCGC
```

FIG.31D

```
6181 TCTGCTAATC CTGTTACCAG TGGCTGCTGC CAGTGGCGAT AAGTCGTGTC TTACCGGGTT
6241 GGACTCAAGA CGATAGTTAC CGGATAAGGC GCAGCGGTCG GCTGAACGG  GGGGTTCGTG
6301 CACACAGCCC AGCTTGGAGC GAACGACCTA CACCGAACTG AGATACCTAC AGCGTGAGCT
6361 ATGAGAAAGC GCCACGCTTC CCGAAGGGAG AAAGGCGGAC AGGTATCCGG TAAGCGGCAG
6421 GGTCGGAACA GGAGAGCGCA CGAGGGAGCT TCCAGGGGGA AACGCCTGGT ATCTTTATAG
6481 TCCTGTCGGG TTTCGCCACC TCTGACTTGA GCGTCGATTT TTGTGATGCT CGTCAGGGGG
6541 GCGGAGCCTA TGGAAAAACG CCAGCAACGC GGCCTTTTTA CGGTTCCTGG CCTTTTGCTG
6601 GCCTTTTGCT CACATGTTCT TTCCTGCGTT ATCCCCTGAT TCTGTGGATA ACCGTATTAC
6661 CGCCTTTGAG TGAGCTGATA CCGCTCGCCG CAGCCGAACG ACCGAGCGCA GCGAGTCAGT
6721 GAGCGAGGAA GCGGAAGAGC GCCCAATACG CAAACCGCCT CTCCCCGCGC GTTGGCCGAT
6781 TCATTAATGC AGCTGGCACG ACAGGTTTCC CGACTGGAAA GCGGGCAGTG AGCGCAACGC
6841 AATTAATGTG AGTTAGCTCA CTCATTAGGC ACCCCAGGCT TTACACTTTA TGCTTCCGGC
6901 TCGTATGTTG TGTGGAATTG TGAGCGGATA ACAATTTCAC ACAGGAAACA GCTATGACCA
6961 TGATTACGCC AAGCGCGCAA TTAACCCTCA CTAAAGGGAA CAAAAGCTGG GTACCGGGCC
7021 CCCCCT
```

FIG.31E pDEST12.2 CMV Promoter for Eukaryotic Expression, SV40
Promoter/ori for G418 Resistance

```
           ┌── mRNA from CMV promoter
307 acc gtc aga tcg cct gga gac gcc atc cac gct gtt ttg acc tca ata gaa
    tgg cag tct agc gga cct ctg cgg tag gtg cga caa aac tgg agg tat ctt 358 gac acc ggg acc gat cca gcc tcc gga ctc tag cct agg ccg cgg agc gga
    ctg tgg ccc tgg cta ggt cgg agg cct gag atc gga tcc ggc gcc tcg cct 409 taa caa ttt cac aca gga aac agc tat gac cat tag gcc ttt gca aaa agc
    att gtt aaa gtg tgt cct ttg tcg ata ctg gta atc cgg aaa cgt ttt tcg Age         EcoRI
460 tat tta ggt gac act ata gaa ggt acg cct gca ggt a|cc ggt ccg g|aa ttc
    ata aat cca ctg tga tat ctt cca tgc gga cgt cca t|gg cc|a ggc ctt a|ag
                                                    ↓             ↓
    Int      attR1
511 cca tca|aca agt tt|g tac aaa aaa gct gaa cga gaa acg taa aat gat ata
    ggt agt|tgt tca aa|c atg ttt ttt cga ctt gct ctt tgc att tta cta tat
```

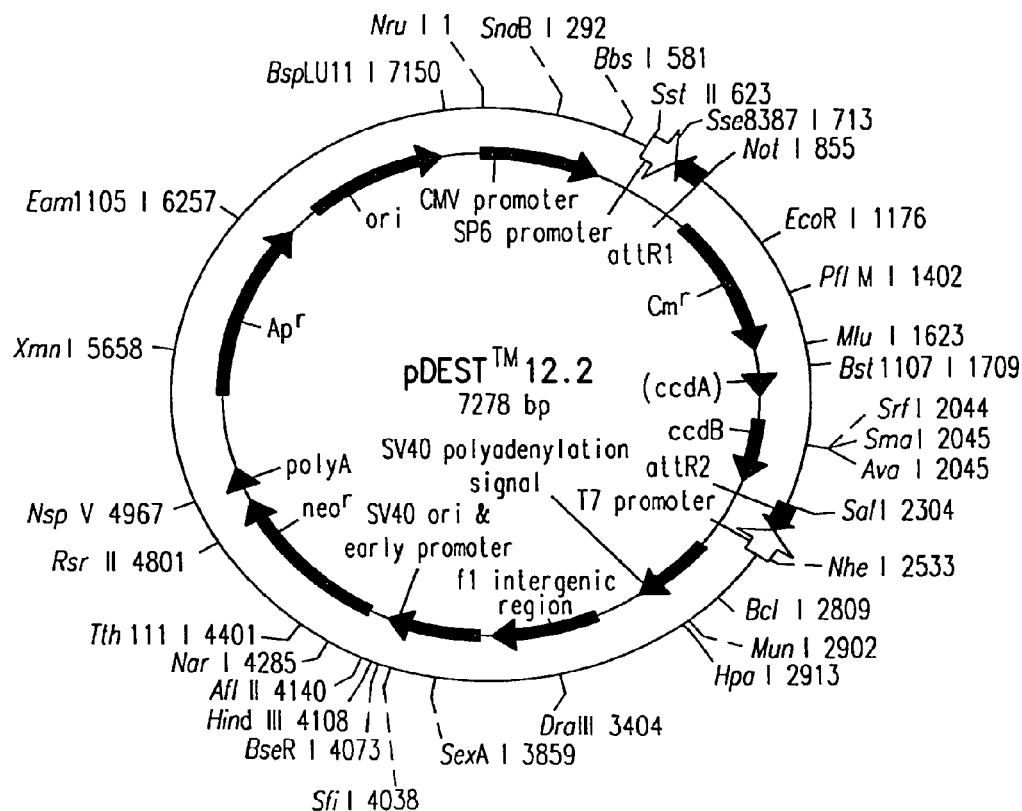

FIG.32A pDEST12.2 7278 bp (rotated to position 3900)

| Location (Base Nos.) | Gene Encoded |
|---|---|
| 86..136 | ori |
| 220..742 | CMV promoter |
| 1059..935 | attR1 |
| 1168..1827 | CmR |
| 1947..2031 | inactivated ccdA |
| 2169..2474 | ccdB |
| 2515..2639 | attR2 |
| 2824..3186 | small t & polyA |
| 3310..3378 | lac |
| 4363..5157 | neo |
| 5680..6540 | ampR |

```
   1 GGGGGGCGGA GCCTATGGAA AAACGCCAGC AACGCGGCCT TTTTACGGTT CCTGGCCTTT
  61 TGCTGGCCTT TTGCTCACAT GTTCTTTCCT GCGTTATCCC CTGATTCTGT GGATAACCGT
 121 ATTACCGCCT TTGAGTGAGC TGATACCGCT CGCCGCAGCC GAACGACCGA GCGCAGCGAG
 181 TCAGTGAGCG AGGAAGCGGA AGAGCTCGCG AATGCATGTC GTTACATAAC TTACGGTAAA
 241 TGGCCCGCCT GGCTGACCGC CCAACGACCC CGCCCATTG ACGTCAATAA TGACGTATGT
 301 TCCCATAGTA ACGCCAATAG GGACTTTCCA TTGACGTCAA TGGGTGGAGT ATTTACGGTA
 361 AACTGCCCAC TTGGCAGTAC ATCAAGTGTA TCATATGCCA AGTACGCCCC CTATTGACGT
 421 CAATGACGGT AAATGGCCCG CCTGGCATTA TGCCCAGTAC ATGACCTTAT GGGACTTTCC
 481 TACTTGGCAG TACATCTACG TATTAGTCAT CGCTATTACC ATGGTGATGC GGTTTTGGCA
 541 GTACATCAAT GGGCGTGGAT AGCGGTTTGA CTCACGGGGA TTTCCAAGTC TCCACCCCAT
 601 TGACGTCAAT GGGAGTTTGT TTTGGCACCA AAATCAACGG GACTTTCCAA AATGTCGTAA
 661 CAACTCCGCC CCATTGACGC AAATGGGCGG TAGGCGTGTA CGGTGGGAGG TCTATATAAG
 721 CAGAGCTCGT TTAGTGAACC GTCAGATCGC CTGGAGACGC CATCCACGCT GTTTTGACCT
 781 CCATAGAAGA CACCGGGACC GATCCAGCCT CCGGACTCTA GCCTAGGCCG CGGGACGGAT
 841 AACAATTTCA CACAGGAAAC AGCTATGACC ATTAGGCCTT TGCAAAAAGC TATTTAGGTG
 901 ACACTATAGA AGGTACGCCT GCAGGTACCG GATCACAAGT TTGTACAAAA AAGCTGAACG
 961 AGAAACGTAA AATGATATAA ATATCAATAT ATTAAATTAG ATTTTGCATA AAAAACAGAC
1021 TACATAATAC TGTAAAACAC AACATATCCA GTCACTATGG CGGCCGCATT AGGCACCCCA
1081 GGCTTTACAC TTTATGCTTC CGGCTCGTAT AATGTGTGGA TTTTGAGTTA GGATCCGTCG
1141 AGATTTTCAG GAGCTAAGGA AGCTAAAATG GAGAAAAAAA TCACTGGATA TACCACCGTT
1201 GATATATCCC AATGGCATCG TAAAGAACAT TTTGAGGCAT TCAGTCAGT TGCTCAATGT
1261 ACCTATAACC AGACCGTTCA GCTGGATATT ACGGCCTTTT TAAAGACCGT AAAGAAAAAT
1321 AAGCACAAGT TTTATCCGGC CTTTATTCAC ATTCTTGCCC GCCTGATGAA TGCTCATCCG
1381 GAATTCCGTA TGGCAATGAA AGACGGTGAG CTGGTGATAT GGGATAGTGT TCACCCTTGT
1441 TACACCGTTT TCCATGAGCA AACTGAAACG TTTTCATCGC TCTGGAGTGA ATACCACGAC
1501 GATTTCCGGC AGTTTCTACA CATATATTCG CAAGATGTGG CGTGTTACGG TGAAAACCTG
1561 GCCTATTTCC CTAAAGGGTT TATTGAGAAT ATGTTTTTCG TCTCAGCCAA TCCCTGGGTG
```

FIG.32B

```
1621 AGTTTCACCA GTTTTGATTT AAACGTGGCC AATATGGACA ACTTCTTCGC CCCCGTTTTC
1681 ACCATGGGCA AATATTATAC GCAAGGCGAC AAGGTGCTGA TGCCGCTGGC GATTCAGGTT
1741 CATCATGCCG TCTGTGATGG CTTCCATGTC GGCAGAATGC TTAATGAATT ACAACAGTAC
1801 TGCGATGAGT GGCAGGGCGG GGCGTAAACG CGTGGATCCG GCTTACTAAA AGCCAGATAA
1861 CAGTATGCGT ATTTGCGCGC TGATTTTTTGC GGTATAAGAA TATATACTGA TATGTATACC
1921 CGAAGTATGT CAAAAAGAGG TGTGCTATGA AGCAGCGTAT TACAGTGACA GTTGACAGCG
1981 ACAGCTATCA GTTGCTCAAG GCATATATGA TGTCAATATC TCCGGTCTGG TAAGCACAAC
2041 CATGCAGAAT GAAGCCCGTC GTCTGCGTGC CGAACGCTGG AAAGCGGAAA ATCAGGAAGG
2101 GATGGCTGAG GTCGCCCGGT TTATTGAAAT GAACGGCTCT TTTGCTGACG AGAACAGGGA
2161 CTGGTGAAAT GCAGTTTAAG GTTTACACCT ATAAAAGAGA GAGCCGTTAT CGTCTGTTTG
2221 TGGATGTACA GAGTGATATT ATTGACACGC CCGGGCGACG GATGGTGATC CCCCTGGCCA
2281 GTGCACGTCT GCTGTCAGAT AAAGTCTCCC GTGAACTTTA CCCGGTGGTG CATATCGGGG
2341 ATGAAAGCTG GCGCATGATG ACCACCGATA TGGCCAGTGT GCCGGTCTCC GTTATCGGGG
2401 AAGAAGTGGC TGATCTCAGC CACCGCGAAA ATGACATCAA AAACGCCATT AACCTGATGT
2461 TCTGGGGAAT ATAAATGTCA GGCTCCCTTA TACACAGCCA GTCTGCAGGT CGACCATAGT
2521 GACTGGATAT GTTGTGTTTT ACAGTATTAT GTAGTCTGTT TTTTATGCAA AATCTAATTT
2581 AATATATTGA TATTTATATC ATTTTACGTT TCTCGTTCAG CTTTCTTGTA CAAAGTGGTG
2641 ATCGCGTGCA TGCGACGTCA TAGCTCTCTC CCTATAGTGA GTCGTATTAT AAGCTAGGCA
2701 CTGGCCGTCG TTTTACAACG TCGTGACTGG GAAAACTGCT AGCTTGGGAT CTTTGTGAAG
2761 GAACCTTACT TCTGTGGTGT GACATAATTG GACAAACTAC CTACAGAGAT TTAAAGCTCT
2821 AAGGTAAATA TAAAATTTTT AAGTGTATAA TGTGTTAAAC TAGCTGCATA TGCTTGCTGC
2881 TTGAGAGTTT TGCTTACTGA GTATGATTTA TGAAAATATT ATACACAGGA GCTAGTGATT
2941 CTAATTGTTT GTGTATTTTA GATTCACAGT CCCAAGGCTC ATTTCAGGCC CCTCAGTCCT
3001 CACAGTCTGT TCATGATCAT AATCAGCCAT ACCACATTTG TAGAGGTTTT ACTTGCTTTA
3061 AAAAACCTCC CACACCTCCC CCTGAACCTG AAACATAAAA TGAATGCAAT TGTTGTTGTT
3121 AACTTGTTTA TTGCAGCTTA TAATGGTTAC AAATAAAGCA ATAGCATCAC AAATTTCACA
3181 AATAAAGCAT TTTTTTCACT GCATTCTAGT TGTGGTTTGT CCAAACTCAT CAATGTATCT
3241 TATCATGTCT GGATCGATCC TGCATTAATG AATCGGCCAA CGCGCGGGGA GAGGCGGTTT
3301 GCGTATTGGC TGGCGTAATA GCGAAGAGGC CCGCACCGAT CGCCCTTCCC AACAGTTGCG
3361 CAGCCTGAAT GGCGAATGGG ACGCGCCCTG TAGCGGCGCA TTAAGCGCGG CGGGTGTGGT
3421 GGTTACGCGC AGCGTGACCG CTACACTTGC CAGCGCCCTA GCGCCCGCTC CTTTCGCTTT
3481 CTTCCCTTCC TTTCTCGCCA CGTTCGCCGG CTTTCCCCGT CAAGCTCTAA ATCGGGGGCT
3541 CCCTTTAGGG TTCCGATTTA GTGCTTTACG GCACCTCGAC CCCAAAAAAC TTGATTAGGG
3601 TGATGGTTCA CGTAGTGGGC CATCGCCCTG ATAGACGGTT TTTCGCCCTT TGACGTTGGA
3661 GTCCACGTTC TTTAATAGTG GACTCTTGTT CCAAACTGGA ACAACACTCA ACCCTATCTC
3721 GGTCTATTCT TTTGATTTAT AAGGGATTTT GCCGATTTCG GCCTATTGGT TAAAAAATGA
3781 GCTGATTTAA CAAATATTTA ACGCGAATTT TAACAAAATA TTAACGTTTA CAATTTCGCC
3841 TGATGCGGTA TTTTCTCCTT ACGCATCTGT GCGGTATTTC ACACCGCATA CGCGGATCTG
3901 CGCAGCACCA TGGCCTGAAA TAACCTCTGA AAGAGGAACT TGGTTAGGTA CCTTCTGAGG
3961 CGGAAAGAAC CAGCTGTGGA ATGTGTGTCA GTTAGGGTGT GGAAAGTCCC CAGGCTCCCC
4021 AGCAGGCAGA AGTATGCAAA GCATGCATCT CAATTAGTCA GCAACCAGGT GTGGAAAGTC
```

FIG.32C

```
4081 CCCAGGCTCC CCAGCAGGCA GAAGTATGCA AAGCATGCAT CTCAATTAGT CAGCAACCAT
4141 AGTCCCGCCC CTAACTCCGC CCATCCCGCC CCTAACTCCG CCCAGTTCCG CCCATTCTCC
4201 GCCCCATGGC TGACTAATTT TTTTTATTTA TGCAGAGGCC GAGGCCGCCT CGGCCTCTGA
4261 GCTATTCCAG AAGTAGTGAG GAGGCTTTTT TGGAGGCCTA GGCTTTTGCA AAAAGCTTGA
4321 TTCTTCTGAC ACAACAGTCT CGAACTTAAG GCTAGAGCCA CCATGATTGA ACAAGATGGA
4381 TTGCACGCAG GTTCTCCGGC CGCTTGGGTG GAGAGGCTAT TCGGCTATGA CTGGGCACAA
4441 CAGACAATCG GCTGCTCTGA TGCCGCCGTG TTCCGGCTGT CAGCGCAGGG GCGCCCGGTT
4501 CTTTTTGTCA AGACCGACCT GTCCGGTGCC CTGAATGAAC TGCAGGACGA GGCAGCGCGG
4561 CTATCGTGGC TGGCCACGAC GGGCGTTCCT TGCGCAGCTG TGCTCGACGT TGTCACTGAA
4621 GCGGGAAGGG ACTGGCTGCT ATTGGGCGAA GTGCCGGGGC AGGATCTCCT GTCATCTCAC
4681 CTTGCTCCTG CCGAGAAAGT ATCCATCATG GCTGATGCAA TGCGGCGGCT GCATACGCTT
4741 GATCCGGCTA CCTGCCCATT CGACCACCAA GCGAAACATC GCATCGAGCG AGCACGTACT
4801 CGGATGGAAG CCGGTCTTGT CGATCAGGAT GATCTGGACG AAGAGCATCA GGGGCTCGCG
4861 CCAGCCGAAC TGTTCGCCAG GCTCAAGGCG CGCATGCCCG ACGGCGAGGA TCTCGTCGTG
4921 ACCCATGGCG ATGCCTGCTT GCCGAATATC ATGGTGGAAA ATGGCCGCTT TTCTGGATTC
4981 ATCGACTGTG GCCGGCTGGG TGTGGCGGAC CGCTATCAGG ACATAGCGTT GGCTACCCGT
5041 GATATTGCTG AAGAGCTTGG CGGCGAATGG GCTGACCGCT TCCTCGTGCT TTACGGTATC
5101 GCCGCTCCCG ATTCGCAGCG CATCGCCTTC TATCGCCTTC TTGACGAGTT CTTCTGAGCG
5161 GGACTCTGGG GTTCGAAATG ACCGACCAAG CGACGCCCAA CCTGCCATCA CGATGGCCGC
5221 AATAAAATAT CTTTATTTTC ATTACATCTG TGTGTTGGTT TTTTGTGTGA ATCGATAGCG
5281 ATAAGGATCC GCGTATGGTG CACTCTCAGT ACAATCTGCT CTGATGCCGC ATAGTTAAGC
5341 CAGCCCCGAC ACCCGCCAAC ACCCGCTGAC GCGCCCTGAC GGGCTTGTCT GCTCCCGGCA
5401 TCCGCTTACA GACAAGCTGT GACCGTCTCC GGGAGCTGCA TGTGTCAGAG GTTTTCACCG
5461 TCATCACCGA AACGCGCGAG ACGAAAGGGC CTCGTGATAC GCCTATTTTT ATAGGTTAAT
5521 GTCATGATAA TAATGGTTTC TTAGACGTCA GGTGGCACTT TTCGGGGAAA TGTGCGCGGA
5581 ACCCCTATTT GTTTATTTTT CTAAATACAT TCAAATATGT ATCCGCTCAT GAGACAATAA
5641 CCCTGATAAA TGCTTCAATA ATATTGAAAA AGGAAGAGTA TGAGTATTCA ACATTTCCGT
5701 GTCGCCCTTA TTCCCTTTTT TGCGGCATTT TGCCTTCCTG TTTTTGCTCA CCCAGAAACG
5761 CTGGTGAAAG TAAAAGATGC TGAAGATCAG TTGGGTGCAC GAGTGGGTTA CATCGAACTG
5821 GATCTCAACA GCGGTAAGAT CCTTGAGAGT TTTCGCCCCG AAGAACGTTT TCCAATGATG
5881 AGCACTTTTA AAGTTCTGCT ATGTGGCGCG GTATTATCCC GTATTGACGC CGGGCAAGAG
5941 CAACTCGGTC GCCGCATACA CTATTCTCAG AATGACTTGG TTGAGTACTC ACCAGTCACA
6001 GAAAAGCATC TTACGGATGG CATGACAGTA AGAGAATTAT GCAGTGCTGC CATAACCATG
6061 AGTGATAACA CTGCGGCCAA CTTACTTCTG ACAACGATCG GAGGACCGAA GGAGCTAACC
6121 GCTTTTTTGC ACAACATGGG GGATCATGTA ACTCGCCTTG ATCGTTGGGA ACCGGAGCTG
6181 AATGAAGCCA TACCAAACGA CGAGCGTGAC ACCACGATGC CTGTAGCAAT GGCAACAACG
6241 TTGCGCAAAC TATTAACTGG CGAACTACTT ACTCTAGCTT CCCGGCAACA ATTAATAGAC
6301 TGGATGGAGG CGGATAAAGT TGCAGGACCA CTTCTGCGCT CGGCCCTTCC GGCTGGCTGG
6361 TTTATTGCTG ATAAATCTGG AGCCGGTGAG CGTGGGTCTC GCGGTATCAT TGCAGCACTG
6421 GGGCCAGATG GTAAGCCCTC CCGTATCGTA GTTATCTACA CGACGGGGAG TCAGGCAACT
6481 ATGGATGAAC GAAATAGACA GATCGCTGAG ATAGGTGCCT CACTGATTAA GCATTGGTAA
```

FIG.32D

```
6541 CTGTCAGACC AAGTTTACTC ATATATACTT TAGATTGATT TAAAACTTCA TTTTTAATTT
6601 AAAAGGATCT AGGTGAAGAT CCTTTTTGAT AATCTCATGA CCAAAATCCC TTAACGTGAG
6661 TTTTCGTTCC ACTGAGCGTC AGACCCCGTA GAAAAGATCA AAGGATCTTC TTGAGATCCT
6721 TTTTTTCTGC GCGTAATCTG CTGCTTGCAA ACAAAAAAAC CACCGCTACC AGCGGTGGTT
6781 TGTTTGCCGG ATCAAGAGCT ACCAACTCTT TTTCCGAAGG TAACTGGCTT CAGCAGAGCG
6841 CAGATACCAA ATACTGTCCT TCTAGTGTAG CCGTAGTTAG GCCACCACTT CAAGAACTCT
6901 GTAGCACCGC CTACATACCT CGCTCTGCTA ATCCTGTTAC CAGTGGCTGC TGCCAGTGGC
6961 GATAAGTCGT GTCTTACCGG GTTGGACTCA AGACGATAGT TACCGGATAA GGCGCAGCGG
7021 TCGGGCTGAA CGGGGGGTTC GTGCACACAG CCCAGCTTGG AGCGAACGAC CTACACCGAA
7081 CTGAGATACC TACAGCGTGA GCATTGAGAA AGCGCCACGC TTCCCGAAGG GAGAAAGGCG
7141 GACAGGTATC CGGTAAGCGG CAGGGTCGGA ACAGGAGAGC GCACGAGGGA GCTTCCAGGG
7201 GGAAACGCCT GGTATCTTTA TAGTCCTGTC GGGTTTCGCC ACCTCTGACT TGAGCGTCGA
7261 TTTTTGTGAT GCTCGTCA
```

FIG.32E

Native protein in E. coli:λP_L promoter

```
               BglII
3721 tgggcaaacc aagacagcta aagatctctc acctaccaaa caatgccccc ctgcaaaaaa
     acccgtttgg ttctgtcgat ttctagagag tggatggttt gttacggggg gacgttttt 3781 taaattcata taaaaaacat acagataacc atctgcggtg ataattatc tctggcggtg
     atttaagtat atttttttgta tgtctattgg tagacgccac tattaatag agaccgccac -35       λP_L promoter   -10         mRNA
3841 ttgacataaa taccactggc ggtgatactg agcacatcag caggacgcac tgaccaccat
     aactgtattt atggtgaccg ccactatgac tcgtgtagtc gtcctgcgtg actggtggta EcoNI
3901 gaaggtgacg ctcttaaaaa ttaagccctg aagaagggca gcattcaaag cagaaggctt
     cttccactgc gagaatttt aattcgggac ttcttcccgt cgtaagttc gtcttccgaa Int     attR1
3961 tggggtgtgt gatacgaaac gaagcattgg gatcatcaca agtttgtaca aaaagctga
     accccacaca ctatgctttg cttcgtaacc ctagtagtgt tcaaacatgt ttttcgact
```

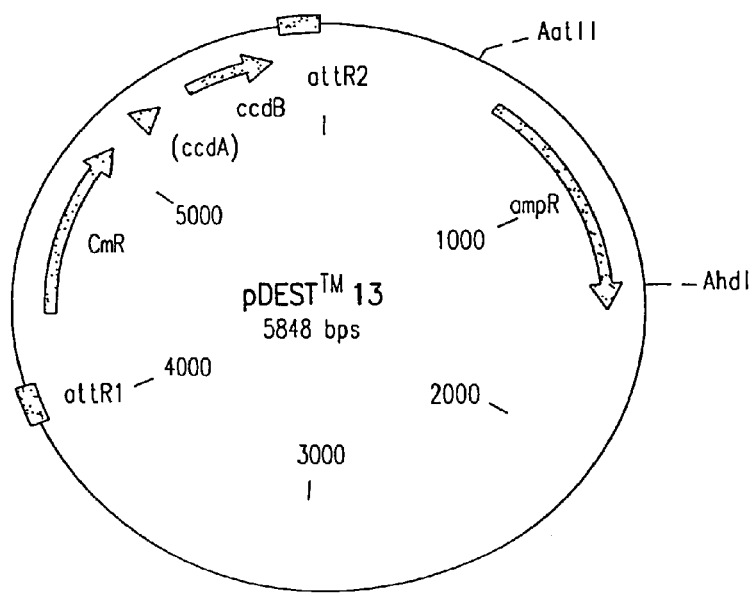

FIG.33A pDEST13 5848 bp

| Location (Base Nos.) | Gene Encoded |
|---|---|
| 599..1458 | ampR |
| 4123..3998 | attR1 |
| 4372..5031 | CmR |
| 5151..5235 | inactivated ccdA |
| 5373..5678 | ccdB |
| 5719..5843 | attR2 |

```
   1 TTCACTGGCC GTCGTTTTAC AACGTCGTGA CTGGGAAAAC CCTGGCGTTA CCCAACTTAA
  61 TCGCCTTGCA GCACATCCCC CTTTCGCCAG CTGGCGTAAT AGCGAAGAGG CCCGCACCGA
 121 TCGCCCTTCC CAACAGTTGC GCAGCCTGAA TGGCGAATGG CGCCTGATGC GGTATTTTCT
 181 CCTTACGCAT CTGTGCGGTA TTTCACACCG CATATGGTGC ACTCTCAGTA CAATCTGCTC
 241 TGATGCCGCA TAGTTAAGCC AGCCCCGACA CCCGCCAACA CCCGCTGACG CGCCCTGACG
 301 GGCTTGTCTG CTCCCGGCAT CCGCTTACAG ACAAGCTGTG ACCGTCTCCG GGAGCTGCAT
 361 GTGTCAGAGG TTTTCACCGT CATCACCGAA ACGCGCGAGA CGAAAGGGCC TCGTGATACG
 421 CCTATTTTTA TAGGTTAATG TCATGATAAT AATGGTTTCT TAGACGTCAG GTGGCACTTT
 481 TCGGGGAAAT GTGCGCGGAA CCCCTATTTG TTTATTTTTC TAAATACATT CAAATATGTA
 541 TCCGCTCATG AGACAATAAC CCTGATAAAT GCTTCAATAA TATTGAAAAA GGAAGAGTAT
 601 GAGTATTCAA CATTTCCGTG TCGCCCTTAT TCCCTTTTTT GCGGCATTTT GCCTTCCTGT
 661 TTTTGCTCAC CCAGAAACGC TGGTGAAAGT AAAAGATGCT GAAGATCAGT TGGGTGCACG
 721 AGTGGGTTAC ATCGAACTGG ATCTCAACAG CGGTAAGATC CTTGAGAGTT TTCGCCCCGA
 781 AGAACGTTTT CCAATGATGA GCACTTTTAA AGTTCTGCTA TGTGGCGCGG TATTATCCCG
 841 TATTGACGCC GGGCAAGAGC AACTCGGTCG CCGCATACAC TATTCTCAGA ATGACTTGGT
 901 TGAGTACTCA CCAGTCACAG AAAAGCATCT TACGGATGGC ATGACAGTAA GAGAATTATG
 961 CAGTGCTGCC ATAACCATGA GTGATAACAC TGCGGCCAAC TTACTTCTGA CAACGATCGG
1021 AGGACCGAAG GAGCTAACCG CTTTTTTGCA CAACATGGGG GATCATGTAA CTCGCCTTGA
1081 TCGTTGGGAA CCGGAGCTGA ATGAAGCCAT ACCAAACGAC GAGCGTGACA CCACGATGCC
1141 TGTAGCAATG GCAACAACGT TGCGCAAACT ATTAACTGGC GAACTACTTA CTCTAGCTTC
1201 CCGGCAACAA TTAATAGACT GGATGGAGGC GGATAAAGTT GCAGGACCAC TTCTGCGCTC
1261 GGCCCTTCCG GCTGGCTGGT TTATTGCTGA TAAATCTGGA GCCGGTGAGC GTGGGTCTCG
1321 CGGTATCATT GCAGCACTGG GGCCAGATGG TAAGCCCTCC CGTATCGTAG TTATCTACAC
1381 GACGGGGAGT CAGGCAACTA TGGATGAACG AAATAGACAG ATCGCTGAGA TAGGTGCCTC
1441 ACTGATTAAG CATTGGTAAC TGTCAGACCA AGTTTACTCA TATATACTTT AGATTGATTT
1501 AAAACTTCAT TTTTAATTTA AAAGGATCTA GGTGAAGATC CTTTTTGATA ATCTCATGAC
1561 CAAAATCCCT TAACGTGAGT TTTCGTTCCA CTGAGCGTCA GACCCCGTAG AAAAGATCAA
1621 AGGATCTTCT TGAGATCCTT TTTTTCTGCG CGTAATCTGC TGCTTGCAAA CAAAAAAACC
1681 ACCGCTACCA GCGGTGGTTT GTTTGCCGGA TCAAGAGCTA CCAACTCTTT TTCCGAAGGT
1741 AACTGGCTTC AGCAGAGCGC AGATACCAAA TACTGTTCTT CTAGTGTAGC CGTAGTTAGG
1801 CCACCACTTC AAGAACTCTG TAGCACCGCC TACATACCTC GCTCTGCTAA TCCTGTTACC
1861 AGTGGCTGCT GCCAGTGGCG ATAAGTCGTG TCTTACCGGG TTGGACTCAA GACGATAGTT
```

FIG.33B

```
1921 ACCGGATAAG GCGCAGCGGT CGGGCTGAAC GGGGGGTTCG TGCACACAGC CCAGCTTGGA
1981 GCGAACGACC TACACCGAAC TGAGATACCT ACAGCGTGAG CATTGAGAAA GCGCCACGCT
2041 TCCCGAAGGG AGAAAGGCGG ACAGGTATCC GGTAAGCGGC AGGGTCGGAA CAGGAGAGCG
2101 CACGAGGGAG CTTCCAGGGG GAAACGCCTG GTATCTTTAT AGTCCTGTCG GGTTTCGCCA
2161 CCTCTGACTT GAGCGTCGAT TTTTGTGATG CTCGTCAGGG GGGCGGAGCC TATGGAAAAA
2221 CGCCAGCAAC GCGGCCTTTT TACGGTTCCT GGCCTTTTGC TGGCCTTTTG CTCACATGTT
2281 CTTTCCTGCG TTATCCCCTG ATTCTGTGGA TAACCGTATT ACCGCCTTTG AGTGAGCTGA
2341 TACCGCTCGC CGCAGCCGAA CGACCGAGCG CAGCGAGTCA GTGAGCGAGG AAGCGGAAGA
2401 GCGCCCAATA CGCAAACCGC CTCTCCCCGC GCGTTGGCCG ATTCATTAAT GCAGCTGGCA
2461 CGACAGGTTT CCCGACTGGA AAGCGGGCAG TGAGCGCAAC GCAATTAATG TGAGTTAGCT
2521 CACTCATTAG GCACCCCAGG CTTTACACTT TATGCTTCCG GCTCGTATGT TGTGTGGAAT
2581 TGTGAGCGGA TAACAATTTC ACACAGGAAA CAGCTATGAC CATGATTACG CCAAGCTTGG
2641 CTGCAGGTGA TGATTATCAG CCAGCAGAGA TTAAGGAAAA CAGACAGGTT TATTGAGCGC
2701 TTATCTTTCC CTTTATTTTT GCTGCGGTAA GTCGCATAAA AACCATTCTT CATAATTCAA
2761 TCCATTTACT ATGTTATGTT CTGAGGGGAG TGAAAATTCC CCTAATTCGA TGAAGATTCT
2821 TGCTCAATTG TTATCAGCTA TGCGCCGACC AGAACACCTT GCCGATCAGC CAAACGTCTC
2881 TTCAGGCCAC TGACTAGCGA TAACTTTCCC CACAACGGAA CAACTCTCAT GCATGGGAT
2941 CATTGGGTAC TGTGGGTTTA GTGGTTGTAA AAACACCTGA CCGCTATCCC TGATCAGTTT
3001 CTTGAAGGTA AACTCATCAC CCCCAAGTCT GGCTATGCAG AAATCACCTG GCTCAACAGC
3061 CTGCTCAGGG TCAACGAGAA TTAACATTCC GTCAGGAAAG CTTGGCTTGG AGCCTGTTGG
3121 TGCGGTCATG GAATTACCTT CAACCTCAAG CCAGAATGCA GAATCACTGG CTTTTTTGGT
3181 TGTGCTTACC CATCTCTCCG CATCACCTTT GGTAAAGGTT CTAAGCTTAG GTGAGAACAT
3241 CCCTGCCTGA ACATGAGAAA AAACAGGGTA CTCATACTCA CTTCTAAGTG ACGGCTGCAT
3301 ACTAACCGCT TCATACATCT CGTAGATTTC TCTGGCGATT GAAGGGCTAA ATTCTTCAAC
3361 GCTAACTTTG AGAATTTTTG CAAGCAATGC GGCGTTATAA GCATTTAATG CATTGATGCC
3421 ATTAAATAAA GCACCAACGC CTGACTGCCC CATCCCCATC TTGTCTGCGA CAGATTCCTG
3481 GGATAAGCCA AGTTCATTTT TCTTTTTTTC ATAAATTGCT TTAAGGCGAC GTGCGTCCTC
3541 AAGCTGCTCT TGTGTTAATG GTTTCTTTTT TGTGCTCATA CGTTAAATCT ATCACCGCAA
3601 GGGATAAATA TCTAACACCG TGCGTGTTGA CTATTTTACC TCTGGCGGTG ATAATGGTTG
3661 CATGTACTAA GGAGGTTGTA TGGAACAACG CATAACCCTG AAAGATTATG CAATGCGCTT
3721 TGGGCAAACC AAGACAGCTA AAGATCTCTC ACCTACCAAA CAATGCCCCC CTGCAAAAAA
3781 TAAATTCATA TAAAAAACAT ACAGATAACC ATCTGCGGTG ATAAATTATC TCTGGCGGTG
3841 TTGACATAAA TACCACTGGC GGTGATACTG AGCACATCAG CAGGACGCAC TGACCACCAT
3901 GAAGGTGACG CTCTTAAAAA TTAAGCCCTG AAGAAGGGCA GCATTCAAAG CAGAAGGCTT
3961 TGGGGTGTGT GATACGAAAC GAAGCATTGG GATCATCACA AGTTTGTACA AAAAAGCTGA
4021 ACGAGAAACG TAAAATGATA TAAATATCAA TATATTAAAT TAGATTTTGC ATAAAAAACA
4081 GACTACATAA TACTGTAAAA CACAACATAT CCAGTCACTA TGGCGGCCGC TAAGTTGGCA
4141 GCATCACCCG ACGCACTTTG CGCCGAATAA ATACCTGTGA CGGAAGATCA CTTCGCAGAA
4201 TAAATAAATC CTGGTGTCCC TGTTGATACC GGGAAGCCCT GGGCCAACTT TTGGCGAAAA
4261 TGAGACGTTG ATCGGCACGT AAGAGGTTCC AACTTTCACC ATAATGAAAT AAGATCACTA
4321 CCGGGCGTAT TTTTTGAGTT ATCGAGATTT TCAGGAGCTA AGGAAGCTAA AATGGAGAAA
```

FIG.33C

```
4381 AAAATCACTG GATATACCAC CGTTGATATA TCCCAATGGC ATCGTAAAGA ACATTTTGAG
4441 GCATTTCAGT CAGTTGCTCA ATGTACCTAT AACCAGACCG TTCAGCTGGA TATTACGGCC
4501 TTTTTAAAGA CCGTAAAGAA AAATAAGCAC AAGTTTTATC CGGCCTTTAT TCACATTCTT
4561 GCCCGCCTGA TGAATGCTCA TCCGGAATTC CGTATGGCAA TGAAAGACGG TGAGCTGGTG
4621 ATATGGGATA GTGTTCACCC TTGTTACACC GTTTTCCATG AGCAAACTGA AACGTTTTCA
4681 TCGCTCTGGA GTGAATACCA CGACGATTTC CGGCAGTTTC TACACATATA TTCGCAAGAT
4741 GTGGCGTGTT ACGGTGAAAA CCTGGCCTAT TTCCCTAAAG GGTTTATTGA GAATATGTTT
4801 TTCGTCTCAG CCAATCCCTG GGTGAGTTTC ACCAGTTTTG ATTTAAACGT GGCCAATATG
4861 GACAACTTCT TCGCCCCCGT TTTCACCATG GGCAAATATT ATACGCAAGG CGACAAGGTG
4921 CTGATGCCGC TGGCGATTCA GGTTCATCAT GCCGTCTGTG ATGGCTTCCA TGTCGGCAGA
4981 ATGCTTAATG AATTACAACA GTACTGCGAT GAGTGGCAGG GCGGGGCGTA AACGCGTGGA
5041 TCCGGCTTAC TAAAAGCCAG ATAACAGTAT GCGTATTTGC GCGCTGATTT TTGCGGTATA
5101 AGAATATATA CTGATATGTA TACCCGAAGT ATGTCAAAAA GAGGTGTGCT ATGAAGCAGC
5161 GTATTACAGT GACAGTTGAC AGCGACAGCT ATCAGTTGCT CAAGGCATAT ATGATGTCAA
5221 TATCTCCGGT CTGGTAAGCA CAACCATGCA GAATGAAGCC CGTCGTCTGC GTGCCGAACG
5281 CTGGAAAGCG GAAAATCAGG AAGGGATGGC TGAGGTCGCC CGGTTTATTG AAATGAACGG
5341 CTCTTTTGCT GACGAGAACA GGGACTGGTG AAATGCAGTT TAAGGTTTAC ACCTATAAAA
5401 GAGAGAGCCG TTATCGTCTG TTTGTGGATG TACAGAGTGA TATTATTGAC ACGCCCGGGC
5461 GACGGATGGT GATCCCCCTG GCCAGTGCAC GTCTGCTGTC AGATAAAGTC TCCCGTGAAC
5521 TTTACCCGGT GGTGCATATC GGGGATGAAA GCTGGCGCAT GATGACCACC GATATGGCCA
5581 GTGTGCCGGT CTCCGTTATC GGGGAAGAAG TGGCTGATCT CAGCCACCGC GAAAATGACA
5641 TCAAAAACGC CATTAACCTG ATGTTCTGGG AATATAAAT GTCAGGCTCC GTTATACACA
5701 GCCAGTCTGC AGGTCGACCA TAGTGACTGG ATATGTTGTG TTTTACAGTA TTATGTAGTC
5761 TGTTTTTTAT GCAAAATCTA ATTTAATATA TTGATATTTA TATCATTTTA CGTTTCTCGT
5821 TCAGCTTTCT TGTACAAAGT GGTGATAA
```

FIG.33D pDEST14 6422 bp (rotated to position 4000)

| Location (Base Nos.) | Gene Encoded |
|---|---|
| 185..61 | attR1 |
| 435..1094 | CmR |
| 1214..1298 | inactivated ccdA |
| 1436..1741 | ccdB |
| 1782..1906 | attR2 |
| 2632..3489 | ampR |

```
   1 CGATCCCGCG AAATTAATAC GACTCACTAT AGGGAGACCA CAACGGTTTC CCTCTAGATC
  61 ACAAGTTTGT ACAAAAAAGC TGAACGAGAA ACGTAAAATG ATATAAATAT CAATATATTA
 121 AATTAGATTT TGCATAAAAA ACAGACTACA TAATACTGTA AAACACAACA TATCCAGTCA
 181 CTATGGCGGC CGCTAAGTTG GCAGCATCAC CCGACGCACT TTGCGCCGAA TAAATACCTG
 241 TGACGGAAGA TCACTTCGCA GAATAAATAA ATCCTGGTGT CCCTGTTGAT ACCGGGAAGC
 301 CCTGGGCCAA CTTTTGGCGA AAATGAGACG TTGATCGGCA CGTAAGAGGT TCCAACTTTC
 361 ACCATAATGA AATAAGATCA CTACCGGGCG TATTTTTTGA GTTATCGAGA TTTTCAGGAG
 421 CTAAGGAAGC TAAAATGGAG AAAAAAATCA CTGGATATAC CACCGTTGAT ATATCCCAAT
 481 GGCATCGTAA AGAACATTTT GAGGCATTTC AGTCAGTTGC TCAATGTACC TATAACCAGA
 541 CCGTTCAGCT GGATATTACG GCCTTTTTAA AGACCGTAAA GAAAAATAAG CACAAGTTTT
 601 ATCCGGCCTT TATTCACATT CTTGCCCGCC TGATGAATGC TCATCCGGAA TTCCGTATGG
 661 CAATGAAAGA CGGTGAGCTG GTGATATGGG ATAGTGTTCA CCCTTGTTAC ACCGTTTTCC
 721 ATGAGCAAAC TGAAACGTTT TCATCGCTCT GGAGTGAATA CCACGACGAT TTCCGGCAGT
 781 TTCTACACAT ATATTCGCAA GATGTGGCGT GTTACGGTGA AAACCTGGCC TATTTCCCTA
 841 AAGGGTTTAT TGAGAATATG TTTTTCGTCT CAGCCAATCC CTGGGTGAGT TTCACCAGTT
 901 TTGATTTAAA CGTGGCCAAT ATGGACAACT TCTTCGCCCC CGTTTTCACC ATGGGCAAAT
 961 ATTATACGCA AGGCGACAAG GTGCTGATGC CGCTGGCGAT TCAGGTTCAT CATGCCGTCT
1021 GTGATGGCTT CCATGTCGGC AGAATGCTTA ATGAATTACA ACAGTACTGC GATGAGTGGC
1081 AGGGCGGGGC GTAAACGCGT GGATCCGGCT TACTAAAAGC CAGATAACAG TATGCGTATT
1141 TGCGCGCTGA TTTTTGCGGT ATAAGAATAT ATACTGATAT GTATACCCGA AGTATGTCAA
1201 AAAGAGGTGT GCTATGAAGC AGCGTATTAC AGTGACAGTT GACAGCGACA GCTATCAGTT
1261 GCTCAAGGCA TATATGATGT CAATATCTCC GGTCTGGTAA GCACAACCAT GCAGAATGAA
1321 GCCCGTCGTC TGCGTGCCGA ACGCTGGAAA GCGGAAAATC AGGAAGGGAT GGCTGAGGTC
1381 GCCCGGTTTA TTGAAATGAA CGGCTCTTTT GCTGACGAGA ACAGGGACTG GTGAAATGCA
1441 GTTTAAGGTT TACACCTATA AAAGAGAGAG CCGTTATCGT CTGTTTGTGG ATGTACAGAG
1501 TGATATTATT GACACGCCCG GGCGACGGAT GGTGATCCCC CTGGCCAGTG CACGTCTGCT
1561 GTCAGATAAA GTCTCCCGTG AACTTTACCC GGTGGTGCAT ATCGGGGATG AAAGCTGGCG
1621 CATGATGACC ACCGATATGG CCAGTGTGCC GGTCTCCGTT ATCGGGGAAG AAGTGGCTGA
1681 TCTCAGCCAC CGCGAAAATG ACATCAAAAA CGCCATTAAC CTGATGTTCT GGGGAATATA
1741 AATGTCAGGC TCCCTTATAC ACAGCCAGTC TGCAGGTCGA CCATAGTGAC TGGATATGTT
1801 GTGTTTTACA GTATTATGTA GTCTGTTTTT TATGCAAAAT CTAATTTAAT ATATTGATAT
1861 TTATATCATT TTACGTTTCT CGTTCAGCTT TCTTGTACAA AGTGGTGATG ATCCGGCTGC
1921 TAACAAAGCC CGAAAGGAAG CTGAGTTGGC TGCTGCCACC GCTGAGCAAT AACTAGCATA
```

FIG.34B

```
1981 ACCCCTTGGG GCCTCTAAAC GGGTCTTGAG GGGTTTTTTG CTGAAAGGAG GAACTATATC
2041 CGGATATCCA CAGGACGGGT GTGGTCGCCA TGATCGCGTA GTCGATAGTG GCTCCAAGTA
2101 GCGAAGCGAG CAGGACTGGG CGGCGGCCAA AGCGGTCGGA CAGTGCTCCG AGAACGGGTG
2161 CGCATAGAAA TTGCATCAAC GCATATAGCG CTAGCAGCAC GCCATAGTGA CTGGCGATGC
2221 TGTCGGAATG GACGATATCC CGCAAGAGGC CCGGCAGTAC CGGCATAACC AAGCCTATGC
2281 CTACAGCATC CAGGGTGACG GTGCCGAGGA TGACGATGAG CGCATTGTTA GATTTCATAC
2341 ACGGTGCCTG ACTGCGTTAG CAATTTAACT GTGATAAACT ACCGCATTAA AGCTTATCGA
2401 TGATAAGCTG TCAAACATGA GAATTCTTGA AGACGAAAGG GCCTCGTGAT ACGCCTATTT
2461 TTATAGGTTA ATGTCATGAT AATAATGGTT TCTTAGACGT CAGGTGGCAC TTTTCGGGGA
2521 AATGTGCGCG GAACCCCTAT TTGTTTATTT TTCTAAATAC ATTCAAATAT GTATCCGCTC
2581 ATGAGACAAT AACCCTGATA AATGCTTCAA TAATATTGAA AAAGGAAGAG TATGAGTATT
2641 CAACATTTCC GTGTCGCCCT TATTCCCTTT TTTGCGGCAT TTTGCCTTCC TGTTTTTGCT
2701 CACCCAGAAA CGCTGGTGAA AGTAAAAGAT GCTGAAGATC AGTTGGGTGC ACGAGTGGGT
2761 TACATCGAAC TGGATCTCAA CAGCGGTAAG ATCCTTGAGA GTTTTCGCCC CGAAGAACGT
2821 TTTCCAATGA TGAGCACTTT TAAAGTTCTG CTATGTGGCG CGGTATTATC CCGTGTTGAC
2881 GCCGGGCAAG AGCAACTCGG TCGCCGCATA CACTATTCTC AGAATGACTT GGTTGAGTAC
2941 TCACCAGTCA CAGAAAAGCA TCTTACGGAT GGCATGACAG TAAGAGAATT ATGCAGTGCT
3001 GCCATAACCA TGAGTGATAA CACTGCGGCC AACTTACTTC TGACAACGAT CGGAGGACCG
3061 AAGGAGCTAA CCGCTTTTTT GCACAACATG GGGGATCATG TAACTCGCCT TGATCGTTGG
3121 GAACCGGAGC TGAATGAAGC CATACCAAAC GACGAGCGTG ACACCACGAT GCCTGCAGCA
3181 ATGGCAACAA CGTTGCGCAA ACTATTAACT GGCGAACTAC TTACTCTAGC TTCCCGGCAA
3241 CAATTAATAG ACTGGATGGA GGCGGATAAA GTTGCAGGAC CACTTCTGCG CTCGGCCCTT
3301 CCGGCTGGCT GGTTTATTGC TGATAAATCT GGAGCCGGTG AGCGTGGGTC TCGCGGTATC
3361 ATTGCAGCAC TGGGGCCAGA TGGTAAGCCC TCCCGTATCG TAGTTATCTA CACGACGGGG
3421 AGTCAGGCAA CTATGGATGA ACGAAATAGA CAGATCGCTG AGATAGGTGC CTCACTGATT
3481 AAGCATTGGT AACTGTCAGA CCAAGTTTAC TCATATATAC TTTAGATTGA TTTAAAACTT
3541 CATTTTTAAT TTAAAAGGAT CTAGGTGAAG ATCCTTTTTG ATAATCTCAT GACCAAAATC
3601 CCTTAACGTG AGTTTTCGTT CCACTGAGCG TCAGACCCCG TAGAAAAGAT CAAAGGATCT
3661 TCTTGAGATC CTTTTTTTCT GCGCGTAATC TGCTGCTTGC AAACAAAAAA ACCACCGCTA
3721 CCAGCGGTGG TTTGTTTGCC GGATCAAGAG CTACCAACTC TTTTTCCGAA GGTAACTGGC
3781 TTCAGCAGAG CGCAGATACC AAATACTGTC CTTCTAGTGT AGCCGTAGTT AGGCCACCAC
3841 TTCAAGAACT CTGTAGCACC GCCTACATAC CTCGCTCTGC TAATCCTGTT ACCAGTGGCT
3901 GCTGCCAGTG GCGATAAGTC GTGTCTTACC GGGTTGGACT CAAGACGATA GTTACCGGAT
3961 AAGGCGCAGC GGTCGGGCTG AACGGGGGGT TCGTGCACAC AGCCCAGCTT GGAGCGAACG
4021 ACCTACACCG AACTGAGATA CCTACAGCGT GAGCTATGAG AAAGCGCCAC GCTTCCCGAA
4081 GGGAGAAAGG CGGACAGGTA TCCGGTAAGC GGCAGGGTCG GAACAGGAGA GCGCACGAGG
4141 GAGCTTCCAG GGGGAAACGC CTGGTATCTT TATAGTCCTG TCGGGTTTCG CCACCTCTGA
4201 CTTGAGCGTC GATTTTTGTG ATGCTCGTCA GGGGGGCGGA GCCTATGGAA AAACGCCAGC
4261 AACGCGGCCT TTTTACGGTT CCTGGCCTTT TGCTGGCCTT TTGCTCACAT GTTCTTTCCT
4321 GCGTTATCCC CTGATTCTGT GGATAACCGT ATTACCGCCT TTGAGTGAGC TGATACCGCT
4381 CGCCGCAGCC GAACGACCGA GCGCAGCGAG TCAGTGAGCG AGGAAGCGGA AGAGCGCCTG
```

FIG.34C

```
4441 ATGCGGTATT TTCTCCTTAC GCATCTGTGC GGTATTTCAC ACCGCATATA TGGTGCACTC
4501 TCAGTACAAT CTGCTCTGAT GCCGCATAGT TAAGCCAGTA TACACTCCGC TATCGCTACG
4561 TGACTGGGTC ATGGCTGCGC CCCGACACCC GCCAACACCC GCTGACGCGC CCTGACGGGC
4621 TTGTCTGCTC CCGGCATCCG CTTACAGACA AGCTGTGACC GTCTCCGGGA GCTGCATGTG
4681 TCAGAGGTTT TCACCGTCAT CACCGAAACG CGCGAGGCAG CTGCGGTAAA GCTCATCAGC
4741 GTGGTCGTGA AGCGATTCAC AGATGTCTGC CTGTTCATCC GCGTCCAGCT CGTTGAGTTT
4801 CTCCAGAAGC GTTAATGTCT GGCTTCTGAT AAAGCGGGCC ATGTTAAGGG CGGTTTTTTC
4861 CTGTTTGGTC ACTGATGCCT CCGTGTAAGG GGGATTTCTG TTCATGGGGG TAATGATACC
4921 GATGAAACGA GAGAGGATGC TCACGATACG GGTTACTGAT GATGAACATG CCCGGTTACT
4981 GGAACGTTGT GAGGGTAAAC AACTGGCGGT ATGGATGCGG CGGGACCAGA GAAAAATCAC
5041 TCAGGGTCAA TGCCAGCGCT TCGTTAATAC AGATGTAGGT GTTCCACAGG GTAGCCAGCA
5101 GCATCCTGCG ATGCAGATCC GGAACATAAT GGTGCAGGGC GCTGACTTCC GCGTTTCCAG
5161 ACTTTACGAA ACACGGAAAC CGAAGACCAT TCATGTTGTT GCTCAGGTCG CAGACGTTTT
5221 GCAGCAGCAG TCGCTTCACG TTCGCTCGCG TATCGGTGAT TCATTCTGCT AACCAGTAAG
5281 GCAACCCCGC CAGCCTAGCC GGGTCCTCAA CGACAGGAGC ACGATCATGC GCACCCGTGG
5341 CCAGGACCCA ACGCTGCCCG AGATGCGCCG CGTGCGGCTG CTGGAGATGG CGGACGCGAT
5401 GGATATGTTC TGCCAAGGGT TGGTTTGCGC ATTCACAGTT CTCCGCAAGA ATTGATTGGC
5461 TCCAATTCTT GGAGTGGTGA ATCCGTTAGC GAGGTGCCGC CGGCTTCCAT TCAGGTCGAG
5521 GTGGCCCGGC TCCATGCACC GCGACGCAAC GCGGGGAGGC AGACAAGGTA TAGGGCGGCG
5581 CCTACAATCC ATGCCAACCC GTTCCATGTG CTCGCCGAGG CGGCATAAAT CGCCGTGACG
5641 ATCAGCGGTC CAGTGATCGA AGTTAGGCTG GTAAGAGCCG CGAGCGATCC TTGAAGCTGT
5701 CCCTGATGGT CGTCATCTAC CTGCCTGGAC AGCATGGCCT GCAACGCGGG CATCCCGATG
5761 CCGCCGGAAG CGAGAAGAAT CATAATGGGG AAGGCCATCC AGCCTCGCGT CGCGAACGCC
5821 AGCAAGACGT AGCCCAGCGC GTCGGCCGCC ATGCCGGCGA TAATGGCCTG CTTCTCGCCG
5881 AAACGTTTGG TGGCGGGACC AGTGACGAAG GCTTGAGCGA GGGCGTGCAA GATTCCGAAT
5941 ACCGCAAGCG ACAGGCCGAT CATCGTCGCG CTCCAGCGAA AGCGGTCCTC GCCGAAAATG
6001 ACCCAGAGCG CTGCCGGCAC CTGTCCTACG AGTTGCATGA TAAAGAAGAC AGTCATAAGT
6061 GCGGCGACGA TAGTCATGCC CCGCGCCCAC CGGAAGGAGC TGACTGGGTT GAAGGCTCTC
6121 AAGGGCATCG GTCGATCGAC GCTCTCCCTT ATGCGACTCC TGCATTAGGA AGCAGCCCAG
6181 TAGTAGGTTG AGGCCGTTGA GCACCGCCGC CGCAAGGAAT GGTGCATGCA AGGAGATGGC
6241 GCCCAACAGT CCCCCGGCCA CGGGGCCTGC CACCATACCC ACGCCGAAAC AAGCGCTCAT
6301 GAGCCCGAAG TGGCGAGCCC GATCTTCCCC ATCGGTGATG TCGGCGATAT AGGCGCCAGC
6361 AACCGCACCT GTGGCGCCGG TGATGCCGGC CACGATGCGT CCGGCGTAGA GGATCGAGAT
6421 CT
```

FIG.34D pDEST15 7013 bp

| Location (Base Nos.) | Gene Encoded |
|---|---|
| 108..776 | GST |
| 916..792 | attR1 |
| 1025..1537 | CmR |
| 1804..1888 | inactivated ccdA |
| 2026..2331 | ccdB |
| 2372..2496 | attR2 |
| 3233..4093 | ampR |

```
   1 ATCGAGATCT CGATCCCGCG AAATTAATAC GACTCACTAT AGGGAGACCA CAACGGTTTC
  61 CCTCTAGAAA TAATTTTGTT TAACTTTAAG AAGGAGATAT ACATATGTCC CCTATACTAG
 121 GTTATTGGAA AATTAAGGGC CTTGTGCAAC CCACTCGACT TCTTTTGGAA TATCTTGAAG
 181 AAAAATATGA AGAGCATTTG TATGAGCGCG ATGAAGGTGA TAAATGGCGA AACAAAAAGT
 241 TTGAATTGGG TTTGGAGTTT CCCAATCTTC CTTATTATAT TGATGGTGAT GTTAAATTAA
 301 CACAGTCTAT GGCCATCATA CGTTATATAG CTGACAAGCA CAACATGTTG GGTGGTTGTC
 361 CAAAAGAGCG TGCAGAGATT TCAATGCTTG AAGGAGCGGT TTTGGATATT AGATACGGTG
 421 TTTCGAGAAT TGCATATAGT AAAGACTTTG AAACTCTCAA AGTTGATTTT CTTAGCAAGC
 481 TACCTGAAAT GCTGAAAATG TTCGAAGATC GTTTATGTCA TAAAACATAT TTAAATGGTG
 541 ATCATGTAAC CCATCCTGAC TTCATGTTGT ATGACGCTCT TGATGTTGTT TTATACATGG
 601 ACCCAATGTG CCTGGATGCG TTCCCAAAAT TAGTTTGTTT TAAAAAACGT ATTGAAGCTA
 661 TCCCACAAAT TGATAAGTAC TTGAAATCCA GCAAGTATAT AGCATGGCCT TTGCAGGGCT
 721 GGCAAGCCAC GTTTGGTGGT GGCGACCATC CTCCAAAATC GGATCTGGTT CCGCGTCCAT
 781 GGTCGAATCA AACAAGTTTG TACAAAAAAG CTGAACGAGA AACGTAAAAT GATATAAATA
 841 TCAATATATT AAATTAGATT TTGCATAAAA AACAGACTAC ATAATACTGT AAAACACAAC
 901 ATATCCAGTC ACTATGGCGG CCGCATTAGG CACCCCAGGC TTTACACTTT ATGCTTCCGG
 961 CTCGTATAAT GTGTGGATTT TGAGTTAGGA TCCGTCGAGA TTTTCAGGAG CTAAGGAAGC
1021 TAAAATGGAG AAAAAAATCA CTGGATATAC CACCGTTGAT ATATCCCAAT GGCATCGTAA
1081 AGAACATTTT GAGGCATTTC AGTCAGTTGC TCAATGTACC TATAACCAGA CCGTTCAGCT
1141 GGATATTACG GCCTTTTTAA AGACCGTAAA GAAAAATAAG CACAAGTTTT ATCCGGCCTT
1201 TATTCACATT CTTGCCCGCC TGATGAATGC TCATCCGGAA TTCCGTATGG CAATGAAAGA
1261 CGGTGAGCTG GTGATATGGG ATAGTGTTCA CCCTTGTTAC ACCGTTTTCC ATGAGCAAAC
1321 TGAAACGTTT TCATCGCTCT GGAGTGAATA CCACGACGAT TTCCGGCAGT TTCTACACAT
1381 ATATTCGCAA GATGTGGCGT GTTACGGTGA AAACCTGGCC TATTTCCCTA AAGGGTTTAT
1441 TGAGAATATG TTTTTCGTCT CAGCCAATCC CTGGGTGAGT TTCACCAGTT TTGATTTAAA
1501 CGTGGCCAAT ATGGACAACT TCTTCGCCCC CGTTTTCACC ATGGGCAAAT ATTATACGCA
1561 AGGCGACAAG GTGCTGATGC CGCTGGCGAT TCAGGTTCAT CATGCCGTCT GTGATGGCTT
1621 CCATGTCGGC AGAATGCTTA ATGAATTACA ACAGTACTGC GATGAGTGGC AGGGCGGGGC
1681 GTAATCTAGA GGATCCGGCT TACTAAAAGC CAGATAACAG TATGCGTATT TGCGCGCTGA
1741 TTTTTTGCGGT ATAAGAATAT ATACTGATAT GTATACCCGA AGTATGTCAA AAAGAGGTGT
1801 GCTATGAAGC AGCGTATTAC AGTGACAGTT GACAGCGACA GCTATCAGTT GCTCAAGGCA
```

FIG.35B

```
1861 TATATGATGT CAATATCTCC GGTCTGGTAA GCACAACCAT GCAGAATGAA GCCCGTCGTC
1921 TGCGTGCCGA ACGCTGGAAA GCGGAAAATC AGGAAGGGAT GGCTGAGGTC GCCCGGTTTA
1981 TTGAAATGAA CGGCTCTTTT GCTGACGAGA ACAGGGACTG GTGAAATGCA GTTTAAGGTT
2041 TACACCTATA AAAGAGAGAG CCGTTATCGT CTGTTTGTGG ATGTACAGAG TGATATTATT
2101 GACACGCCCG GCGACGGAT GGTGATCCCC CTGGCCAGTG CACGTCTGCT GTCAGATAAA
2161 GTCTCCCGTG AACTTTACCC GGTGGTGCAT ATCGGGGATG AAAGCTGGCG CATGATGACC
2221 ACCGATATGG CCAGTGTGCC GGTCTCCGTT ATCGGGGAAG AAGTGGCTGA TCTCAGCCAC
2281 CGCGAAAATG ACATCAAAAA CGCCATTAAC CTGATGTTCT GGGGAATATA AATGTCAGGC
2341 TCCCTTATAC ACAGCCAGTC TGCAGGTCGA CCATAGTGAC TGGATATGTT GTGTTTTACA
2401 GTATTATGTA GTCTGTTTTT TATGCAAAAT CTAATTTAAT ATATTGATAT TTATATCATT
2461 TTACGTTTCT CGTTCAGCTT TCTTGTACAA AGTGGTTTGA TTCGACCCGG GATCCGGCTG
2521 CTAACAAAGC CCGAAAGGAA GCTGAGTTGG CTGCTGCCAC CGCTGAGCAA TAACTAGCAT
2581 AACCCCTTGG GGCCTCTAAA CGGGTCTTGA GGGGTTTTTT GCTGAAAGGA GGAACTATAT
2641 CCGGATATCC ACAGGACGGG TGTGGTCGCC ATGATCGCGT AGTCGATAGT GGCTCCAAGT
2701 AGCGAAGCGA GCAGGACTGG GCGGCGGCCA AAGCGGTCGG ACAGTGCTCC GAGAACGGGT
2761 GCGCATAGAA ATTGCATCAA CGCATATAGC GCTAGCAGCA CGCCATAGTG ACTGGCGATG
2821 CTGTCGGAAT GGACGATATC CCGCAAGAGG CCCGGCAGTA CCGGCATAAC CAAGCCTATG
2881 CCTACAGCAT CCAGGGTGAC GGTGCCGAGG ATGACGATGA GCGCATTGTT AGATTTCATA
2941 CACGGTGCCT GACTGCGTTA GCAATTTAAC TGTGATAAAC TACCGCATTA AAGCTTATCG
3001 ATGATAAGCT GTCAAACATG AGAATTCTTG AAGACGAAAG GGCCTCGTGA TACGCCTATT
3061 TTTATAGGTT AATGTCATGA TAATAATGGT TTCTTAGACG TCAGGTGGCA CTTTTCGGGG
3121 AAATGTGCGC GGAACCCCTA TTTGTTTATT TTTCTAAATA CATTCAAATA TGTATCCGCT
3181 CATGAGACAA TAACCCTGAT AAATGCTTCA ATAATATTGA AAAAGGAAGA GTATGAGTAT
3241 TCAACATTTC CGTGTCGCCC TTATTCCCTT TTTTGCGGCA TTTTGCCTTC CTGTTTTTGC
3301 TCACCCAGAA ACGCTGGTGA AAGTAAAAGA TGCTGAAGAT CAGTTGGGTG CACGAGTGGG
3361 TTACATCGAA CTGGATCTCA ACAGCGGTAA GATCCTTGAG AGTTTTCGCC CCGAAGAACG
3421 TTTTCCAATG ATGAGCACTT TTAAAGTTCT GCTATGTGGC GCGGTATTAT CCCGTGTTGA
3481 CGCCGGGCAA GAGCAACTCG GTCGCCGCAT ACACTATTCT CAGAATGACT TGGTTGAGTA
3541 CTCACCAGTC ACAGAAAAGC ATCTTACGGA TGGCATGACA GTAAGAGAAT TATGCAGTGC
3601 TGCCATAACC ATGAGTGATA ACACTGCGGC CAACTTACTT CTGACAACGA TCGGAGGACC
3661 GAAGGAGCTA ACCGCTTTTT TGCACAACAT GGGGGATCAT GTAACTCGCC TTGATCGTTG
3721 GGAACCGGAG CTGAATGAAG CCATACCAAA CGACGAGCGT GACACCACGA TGCCTGCAGC
3781 AATGGCAACA ACGTTGCGCA AACTATTAAC TGGCGAACTA CTTACTCTAG CTTCCCGGCA
3841 ACAATTAATA GACTGGATGG AGGCGGATAA AGTTGCAGGA CCACTTCTGC GCTCGGCCCT
3901 TCCGGCTGGC TGGTTTATTG CTGATAAATC TGGAGCCGGT GAGCGTGGGT CTCGCGGTAT
3961 CATTGCAGCA CTGGGGCCAG ATGGTAAGCC CTCCCGTATC GTAGTTATCT ACACGACGGG
4021 GAGTCAGGCA ACTATGGATG AACGAAATAG ACAGATCGCT GAGATAGGTG CCTCACTGAT
4081 TAAGCATTGG TAACTGTCAG ACCAAGTTTA CTCATATATA CTTTAGATTG ATTTAAAACT
4141 TCATTTTTAA TTTAAAAGGA TCTAGGTGAA GATCCTTTTT GATAATCTCA TGACCAAAAT
4201 CCCTTAACGT GAGTTTTCGT TCCACTGAGC GTCAGACCCC GTAGAAAAGA TCAAAGGATC
4261 TTCTTGAGAT CCTTTTTTTC TGCGCGTAAT CTGCTGCTTG CAAACAAAAA AACCACCGCT
```

FIG.35C

```
4321 ACCAGCGGTG GTTTGTTTGC CGGATCAAGA GCTACCAACT CTTTTTCCGA AGGTAACTGG
4381 CTTCAGCAGA GCGCAGATAC CAAATACTGT CCTTCTAGTG TAGCCGTAGT TAGGCCACCA
4441 CTTCAAGAAC TCTGTAGCAC CGCCTACATA CCTCGCTCTG CTAATCCTGT TACCAGTGGC
4501 TGCTGCCAGT GGCGATAAGT CGTGTCTTAC CGGGTTGGAC TCAAGACGAT AGTTACCGGA
4561 TAAGGCGCAG CGGTCGGGCT GAACGGGGGG TTCGTGCACA CAGCCCAGCT TGGAGCGAAC
4621 GACCTACACC GAACTGAGAT ACCTACAGCG TGAGCTATGA GAAAGCGCCA CGCTTCCCGA
4681 AGGGAGAAAG GCGGACAGGT ATCCGGTAAG CGGCAGGGTC GGAACAGGAG AGCGCACGAG
4741 GGAGCTTCCA GGGGGAAACG CCTGGTATCT TTATAGTCCT GTCGGGTTTC GCCACCTCTG
4801 ACTTGAGCGT CGATTTTTGT GATGCTCGTC AGGGGGGCGG AGCCTATGGA AAAACGCCAG
4861 CAACGCGGCC TTTTTACGGT TCCTGGCCTT TTGCTGGCCT TTTGCTCACA TGTTCTTTCC
4921 TGCGTTATCC CCTGATTCTG TGGATAACCG TATTACCGCC TTTGAGTGAG CTGATACCGC
4981 TCGCCGCAGC CGAACGACCG AGCGCAGCGA GTCAGTGAGC GAGGAAGCGG AAGAGCGCCT
5041 GATGCGGTAT TTTCTCCTTA CGCATCTGTG CGGTATTTCA CACCGCATAT ATGGTGCACT
5101 CTCAGTACAA TCTGCTCTGA TGCCGCATAG TTAAGCCAGT ATACACTCCG CTATCGCTAC
5161 GTGACTGGGT CATGGCTGCG CCCCGACACC CGCCAACACC CGCTGACGCG CCCTGACGGG
5221 CTTGTCTGCT CCCGGCATCC GCTTACAGAC AAGCTGTGAC CGTCTCCGGG AGCTGCATGT
5281 GTCAGAGGTT TTCACCGTCA TCACCGAAAC GCGCGAGGCA GCTGCGGTAA AGCTCATCAG
5341 CGTGGTCGTG AAGCGATTCA CAGATGTCTG CCTGTTCATC CGCGTCCAGC TCGTTGAGTT
5401 TCTCCAGAAG CGTTAATGTC TGGCTTCTGA TAAAGCGGGC CATGTTAAGG GCGGTTTTTT
5461 CCTGTTTGGT CACTGATGCC TCCGTGTAAG GGGGATTTCT GTTCATGGGG GTAATGATAC
5521 CGATGAAACG AGAGAGGATG CTCACGATAC GGGTTACTGA TGATGAACAT GCCCGGTTAC
5581 TGGAACGTTG TGAGGGTAAA CAACTGGCGG TATGGATGCG GCGGGACCAG AGAAAAATCA
5641 CTCAGGGTCA ATGCCAGCGC TTCGTTAATA CAGATGTAGG TGTTCCACAG GGTAGCCAGC
5701 AGCATCCTGC GATGCAGATC CGGAACATAA TGGTGCAGGG CGCTGACTTC CGCGTTTCCA
5761 GACTTTACGA AACACGGAAA CCGAAGACCA TTCATGTTGT TGCTCAGGTC GCAGACGTTT
5821 TGCAGCAGCA GTCGCTTCAC GTTCGCTCGC GTATCGGTGA TTCATTCTGC TAACCAGTAA
5881 GGCAACCCCG CCAGCCTAGC CGGGTCCTCA ACGACAGGAG CACGATCATG CGCACCCGTG
5941 GCCAGGACCC AACGCTGCCC GAGATGCGCC GCGTGCGGCT GCTGGAGATG CGGACGCGA
6001 TGGATATGTT CTGCCAAGGG TTGGTTTGCG CATTCACAGT TCTCCGCAAG AATTGATTGG
6061 CTCCAATTCT TGGAGTGGTG AATCCGTTAG CGAGGTGCCG CCGGCTTCCA TTCAGGTCGA
6121 GGTGGCCCGG CTCCATGCAC CGCGACGCAA CGCGGGGAGG CAGACAAGGT ATAGGGCGGC
6181 GCCTACAATC CATGCCAACC CGTTCCATGT GCTCGCCGAG GCGGCATAAA TCGCCGTGAC
6241 GATCAGCGGT CCAGTGATCG AAGTTAGGC GGTAAGAGCC GCGAGCGATC CTTGAAGCTG
6301 TCCCTGATGG TCGTCATCTA CCTGCCTGGA CAGCATGGCC TGCAACGCGG GCATCCCGAT
6361 GCCGCCGGAA GCGAGAAGAA TCATAATGGG GAAGGCCATC CAGCCTCGCG TCGCGAACGC
6421 CAGCAAGACG TAGCCCAGCG CGTCGGCCGC CATGCCGGCG ATAATGGCCT GCTTCTCGCC
6481 GAAACGTTTG GTGGCGGGAC CAGTGACGAA GGCTTGAGCG AGGGCGTGCA AGATTCCGAA
6541 TACCGCAAGC GACAGGCCGA TCATCGTCGC GCTCCAGCGA AAGCGGTCCT CGCCGAAAAT
6601 GACCCAGAGC GCTGCCGGCA CCTGTCCTAC GAGTTGCATG ATAAAGAAGA CAGTCATAAG
6661 TGCGGCGACG ATAGTCATGC CCCGCGCCCA CCGGAAGGAG CTGACTGGGT TGAAGGCTCT
6721 CAAGGGCATC GGTCGATCGA CGCTCTCCCT TATGCGACTC CTGCATTAGG AAGCAGCCCA
6781 GTAGTAGGTT GAGGCCGTTG AGCACCGCCG CCGCAAGGAA TGGTGCATGC AAGGAGATGG
6841 CGCCCAACAG TCCCCCGGCC ACGGGGCCTG CCACCATACC CACGCCGAAA CAAGCGCTCA
6901 TGAGCCCGAA GTGGCGAGCC CGATCTTCCC CATCGGTGAT GTCGGCGATA TAGGCGCCAG
6961 CAACCGCACC TGTGGCGCCG GTGATGCCGG CCACGATGCG TCCGGCGTAG AGG
```

FIG.35D pDEST16 6675 bp

| Location (Base Nos.) | Gene Encoded |
|---|---|
| 104..457 | trxA |
| 585..461 | attR1 |
| 694..1353 | CmR |
| 1473..1557 | inactivated ccdA |
| 1695..2000 | ccdB |
| 2041..2165 | attR2 |

```
   1 AGATCTCGAT CCCGCGAAAT TAATACGACT CACTATAGGG AGACCACAAC GGTTTCCCTC
  61 TAGAAATAAT TTTGTTTAAC TTTAAGAAGG AGATATACAT ATGAGCGATA AAATTATTCA
 121 CCTGACTGAC GACAGTTTTG ACACGGATGT ACTCAAAGCG GACGGGGCGA TCCTCGTCGA
 181 TTTCTGGGCA GAGTGGTGCG GTCCGTGCAA AATGATCGCC CCGATTCTGG ATGAAATCGC
 241 TGACGAATAT CAGGGCAAAC TGACCGTTGC AAAACTGAAC ATCGATCAAA ACCCTGGCAC
 301 TGCGCCGAAA TATGGCATCC GTGGTATCCC GACTCTGCTG CTGTTCAAAA ACGGTGAAGT
 361 GGCGGCAACC AAAGTGGGTG CACTGTCTAA AGGTCAGTTG AAAGAGTTCC TCGACGCTAA
 421 CCTGGCCGGT TCTGGTTCTG GTGATGACGA TGACAAGATC ACAAGTTTGT ACAAAAAAGC
 481 TGAACGAGAA ACGTAAAATG ATATAAATAT CAATATATTA AATTAGATTT TGCATAAAAA
 541 ACAGACTACA TAATACTGTA AAACACAACA TATCCAGTCA CTATGGCGGC CGCATTAGGC
 601 ACCCCAGGCT TTACACTTTA TGCTTCCGGC TCGTATAATG TGTGGATTTT GAGTTAGGAT
 661 CCGGCGAGAT TTTCAGGAGC TAAGGAAGCT AAAATGGAGA AAAAAATCAC TGGATATACC
 721 ACCGTTGATA TATCCCAATG GCATCGTAAA GAACATTTTG AGGCATTTCA GTCAGTTGCT
 781 CAATGTACCT ATAACCAGAC CGTTCAGCTG GATATTACGG CCTTTTTAAA GACCGTAAAG
 841 AAAAATAAGC ACAAGTTTTA TCCGGCCTTT ATTCACATTC TTGCCCGCCT GATGAATGCT
 901 CATCCGGAAT TCCGTATGGC AATGAAAGAC GGTGAGCTGG TGATATGGGA TAGTGTTCAC
 961 CCTTGTTACA CCGTTTTCCA TGAGCAAACT GAAACGTTTT CATCGCTCTG GAGTGAATAC
1021 CACGACGATT TCCGGCAGTT TCTACACATA TATTCGCAAG ATGTGGCGTG TTACGGTGAA
1081 AACCTGGCCT ATTTCCCTAA AGGGTTTATT GAGAATATGT TTTTCGTCTC AGCCAATCCC
1141 TGGGTGAGTT TCACCAGTTT TGATTTAAAC GTGGCCAATA TGGACAACTT CTTCGCCCCC
1201 GTTTTCACCA TGGGCAAATA TTATACGCAA GGCGACAAGG TGCTGATGCC GCTGGCGATT
1261 CAGGTTCATC ATGCCGTCTG TGATGGCTTC CATGTCGGCA GAATGCTTAA TGAATTACAA
1321 CAGTACTGCG ATGAGTGGCA GGGCGGGGCG TAAACGCGTG GATCCGGCTT ACTAAAAGCC
1381 AGATAACAGT ATGCGTATTT GCGCGCTGAT TTTTGCGGTA TAAGAATATA TACTGATATG
1441 TATACCCGAA GTATGTCAAA AAGAGGTGTG CTATGAAGCA GCGTATTACA GTGACAGTTG
1501 ACAGCGACAG CTATCAGTTG CTCAAGGCAT ATATGATGTC AATATCTCCG GTCTGGTAAG
1561 CACAACCATG CAGAATGAAG CCCGTCGTCT GCGTGCCGAA CGCTGGAAAG CGGAAAATCA
1621 GGAAGGGATG GCTGAGGTCG CCCGGTTTAT TGAAATGAAC GGCTCTTTTG CTGACGAGAA
1681 CAGGGACTGG TGAAATGCAG TTTAAGGTTT ACACCTATAA AAGAGAGAGC CGTTATCGTC
1741 TGTTTGTGGA TGTACAGAGT GATATTATTG ACACGCCCGG GCGACGGATG GTGATCCCCC
1801 TGGCCAGTGC ACGTCTGCTG TCAGATAAAG TCTCCCGTGA ACTTTACCCG GTGGTGCATA
1861 TCGGGGATGA AAGCTGGCGC ATGATGACCA CCGATATGGC CAGTGTGCCG GTCTCCGTTA
1921 TCGGGGAAGA AGTGGCTGAT CTCAGCCACC GCGAAAATGA CATCAAAAAC GCCATTAACC
```

FIG.36B

```
1981 TGATGTTCTG GGGAATATAA ATGTCAGGCT CCCTTATACA CAGCCAGTCT GCAGGTCGAC
2041 CATAGTGACT GGATATGTTG TGTTTTACAG TATTATGTAG TCTGTTTTTT ATGCAAAATC
2101 TAATTTAATA TATTGATATT TATATCATTT TACGTTTCTC GTTCAGCTTT CTTGTACAAA
2161 GTGGTGATGA TCCGGCTGCT AACAAAGCCC GAAAGGAAGC TGAGTTGGCT GCTGCCACCG
2221 CTGAGCAATA ACTAGCATAA CCCCTTGGGG CCTCTAAACG GGTCTTGAGG GGTTTTTTGC
2281 TGAAAGGAGG AACTATATCC GGATATCCAC AGGACGGGTG TGGTCGCCAT GATCGCGTAG
2341 TCGATAGTGG CTCCAAGTAG CGAAGCGAGC AGGACTGGGC GGCGGCCAAA GCGGTCGGAC
2401 AGTGCTCCGA GAACGGGTGC GCATAGAAAT TGCATCAACG CATATAGCGC TAGCAGCACG
2461 CCATAGTGAC TGGCGATGCT GTCGGAATGG ACGATATCCC GCAAGAGGCC CGGCAGTACC
2521 GGCATAACCA AGCCTATGCC TACAGCATCC AGGGTGACGG TGCCGAGGAT GACGATGAGC
2581 GCATTGTTAG ATTTCATACA CGGTGCCTGA CTGCGTTAGC AATTTAACTG TGATAAACTA
2641 CCGCATTAAA GCTTATCGAT GATAAGCTGT CAAACATGAG AATTCTTGAA GACGAAAGGG
2701 CCTCGTGATA CGCCTATTTT TATAGGTTAA TGTCATGATA ATAATGGTTT CTTAGACGTC
2761 AGGTGGCACT TTTCGGGGAA ATGTGCGCGG AACCCCTATT TGTTTATTTT TCTAAATACA
2821 TTCAAATATG TATCCGCTCA TGAGACAATA ACCCTGATAA ATGCTTCAAT AATATTGAAA
2881 AAGGAAGAGT ATGAGTATTC AACATTTCCG TGTCGCCCTT ATTCCCTTTT TTGCGGCATT
2941 TTGCCTTCCT GTTTTTGCTC ACCCAGAAAC GCTGGTGAAA GTAAAAGATG CTGAAGATCA
3001 GTTGGGTGCA CGAGTGGGTT ACATCGAACT GGATCTCAAC AGCGGTAAGA TCCTTGAGAG
3061 TTTTCGCCCC GAAGAACGTT TTCCAATGAT GAGCACTTTT AAAGTTCTGC TATGTGGCGC
3121 GGTATTATCC CGTGTTGACG CCGGGCAAGA GCAACTCGGT CGCCGCATAC ACTATTCTCA
3181 GAATGACTTG GTTGAGTACT CACCAGTCAC AGAAAAGCAT CTTACGGATG GCATGACAGT
3241 AAGAGAATTA TGCAGTGCTG CCATAACCAT GAGTGATAAC ACTGCGGCCA ACTTACTTCT
3301 GACAACGATC GGAGGACCGA AGGAGCTAAC CGCTTTTTTG CACAACATGG GGGATCATGT
3361 AACTCGCCTT GATCGTTGGG AACCGGAGCT GAATGAAGCC ATACCAAACG ACGAGCGTGA
3421 CACCACGATG CCTGCAGCAA TGGCAACAAC GTTGCGCAAA CTATTAACTG GCGAACTACT
3481 TACTCTAGCT TCCCGGCAAC AATTAATAGA CTGGATGGAG GCGGATAAAG TTGCAGGACC
3541 ACTTCTGCGC TCGGCCCTTC CGGCTGGCTG GTTTATTGCT GATAAATCTG GAGCCGGTGA
3601 GCGTGGGTCT CGCGGTATCA TTGCAGCACT GGGGCCAGAT GGTAAGCCCT CCCGTATCGT
3661 AGTTATCTAC ACGACGGGGA GTCAGGCAAC TATGGATGAA CGAAATAGAC AGATCGCTGA
3721 GATAGGTGCC TCACTGATTA AGCATTGGTA ACTGTCAGAC CAAGTTTACT CATATATACT
3781 TTAGATTGAT TTAAAACTTC ATTTTTAATT TAAAAGGATC TAGGTGAAGA TCCTTTTTGA
3841 TAATCTCATG ACCAAAATCC CTTAACGTGA GTTTTCGTTC CACTGAGCGT CAGACCCCGT
3901 AGAAAAGATC AAAGGATCTT CTTGAGATCC TTTTTTTCTG CGCGTAATCT GCTGCTTGCA
3961 AACAAAAAAA CCACCGCTAC CAGCGGTGGT TTGTTTGCCG GATCAAGAGC TACCAACTCT
4021 TTTTCCGAAG GTAACTGGCT TCAGCAGAGC GCAGATACCA AATACTGTCC TTCTAGTGTA
4081 GCCGTAGTTA GGCCACCACT TCAAGAACTC TGTAGCACCG CCTACATACC TCGCTCTGCT
4141 AATCCTGTTA CCAGTGGCTG CTGCCAGTGG CGATAAGTCG TGTCTTACCG GGTTGGACTC
4201 AAGACGATAG TTACCGGATA AGGCGCAGCG GTCGGGCTGA ACGGGGGGTT CGTGCACACA
4261 GCCCAGCTTG GAGCGAACGA CCTACACCGA ACTGAGATAC CTACAGCGTG AGCTATGAGA
4321 AAGCGCCACG CTTCCCGAAG GGAGAAAGGC GGACAGGTAT CCGGTAAGCG GCAGGGTCGG
4381 AACAGGAGAG CGCACGAGGG AGCTTCCAGG GGGAAACGCC TGGTATCTTT ATAGTCCTGT
```

FIG.36C

```
4441 CGGGTTTCGC CACCTCTGAC TTGAGCGTCG ATTTTTGTGA TGCTCGTCAG GGGGGCGGAG
4501 CCTATGGAAA AACGCCAGCA ACGCGGCCTT TTTACGGTTC CTGGCCTTTT GCTGGCCTTT
4561 TGCTCACATG TTCTTTCCTG CGTTATCCCC TGATTCTGTG GATAACCGTA TTACCGCCTT
4621 TGAGTGAGCT GATACCGCTC GCCGCAGCCG AACGACCGAG CGCAGCGAGT CAGTGAGCGA
4681 GGAAGCGGAA GAGCGCCTGA TGCGGTATTT TCTCCTTACG CATCTGTGCG GTATTTCACA
4741 CCGCATATAT GGTGCACTCT CAGTACAATC TGCTCTGATG CCGCATAGTT AAGCCAGTAT
4801 ACACTCCGCT ATCGCTACGT GACTGGGTCA TGGCTGCGCC CCGACACCCG CCAACACCCG
4861 CTGACGCGCC CTGACGGGCT TGTCTGCTCC CGGCATCCGC TTACAGACAA GCTGTGACCG
4921 TCTCCGGGAG CTGCATGTGT CAGAGGTTTT CACCGTCATC ACCGAAACGC GCGAGGCAGC
4981 TGCGGTAAAG CTCATCAGCG TGGTCGTGAA GCGATTCACA GATGTCTGCC TGTTCATCCG
5041 CGTCCAGCTC GTTGAGTTTC TCCAGAAGCG TTAATGTCTG GCTTCTGATA AAGCGGGCCA
5101 TGTTAAGGGC GGTTTTTTCC TGTTTGGTCA CTGATGCCTC CGTGTAAGGG GGATTTCTGT
5161 TCATGGGGGT AATGATACCG ATGAAACGAG AGAGGATGCT CACGATACGG GTTACTGATG
5221 ATGAACATGC CCGGTTACTG GAACGTTGTG AGGGTAAACA ACTGGCGGTA TGGATGCGGC
5281 GGGACCAGAG AAAAATCACT CAGGGTCAAT GCCAGCGCTT CGTTAATACA GATGTAGGTG
5341 TTCCACAGGG TAGCCAGCAG CATCCTGCGA TGCAGATCCG GAACATAATG GTGCAGGGCG
5401 CTGACTTCCG CGTTTCCAGA CTTTACGAAA CACGGAAACC GAAGACCATT CATGTTGTTG
5461 CTCAGGTCGC AGACGTTTTG CAGCAGCAGT CGCTTCACGT TCGCTCGCGT ATCGGTGATT
5521 CATTCTGCTA ACCAGTAAGG CAACCCCGCC AGCCTAGCCG GTCCTCAAC GACAGGAGCA
5581 CGATCATGCG CACCCGTGGC CAGGACCCAA CGCTGCCCGA GATGCGCCGC GTGCGGCTGC
5641 TGGAGATGGC GGACGCGATG GATATGTTCT GCCAAGGGTT GGTTTGCGCA TTCACAGTTC
5701 TCCGCAAGAA TTGATTGGCT CCAATTCTTG GAGTGGTGAA TCCGTTAGCG AGGTGCCGCC
5761 GGCTTCCATT CAGGTCGAGG TGGCCCGGCT CCATGCACCG CGACGCAACG CGGGGAGGCA
5821 GACAAGGTAT AGGGCGGCGC CTACAATCCA TGCCAACCCG TTCCATGTGC TCGCCGAGGC
5881 GGCATAAATC GCCGTGACGA TCAGCGGTCC AGTGATCGAA GTTAGGCTGG TAAGAGCCGC
5941 GAGCGATCCT TGAAGCTGTC CCTGATGGTC GTCATCTACC TGCCTGGACA GCATGGCCTG
6001 CAACGCGGGC ATCCCGATGC CGCCGGAAGC GAGAAGAATC ATAATGGGGA AGGCCATCCA
6061 GCCTCGCGTC GCGAACGCCA GCAAGACGTA GCCCAGCGCG TCGGCCGCCA TGCCGGCGAT
6121 AATGGCCTGC TTCTCGCCGA AACGTTTGGT GGCGGGACCA GTGACGAAGG CTTGAGCGAG
6181 GGCGTGCAAG ATTCCGAATA CCGCAAGCGA CAGGCCGATC ATCGTCGCGC TCCAGCGAAA
6241 GCGGTCCTCG CCGAAAATGA CCCAGAGCGC TGCCGGCACC TGTCCTACGA GTTGCATGAT
6301 AAAGAAGACA GTCATAAGTG CGGCGACGAT AGTCATGCCC CGCGCCCACC GGAAGGAGCT
6361 GACTGGGTTG AAGGCTCTCA AGGGCATCGG TCGATCGACG CTCTCCCTTA TGCGACTCCT
6421 GCATTAGGAA GCAGCCCAGT AGTAGGTTGA GGCCGTTGAG CACCGCCGCC GCAAGGAATG
6481 GTGCATGCAA GGAGATGGCG CCCAACAGTC CCCCGGCCAC GGGGCCTGCC ACCATACCCA
6541 CGCCGAAACA AGCGCTCATG AGCCCGAAGT GGCGAGCCCG ATCTTCCCCA TCGGTGATGT
6601 CGGCGATATA GGCGCCAGCA ACCGCACCTG TGGCGCCGGT GATGCCGGCC ACGATGCGTC
6661 CGGCGTAGAG GATCG
```

FIG.36D pDEST17 6354 bp

| Location (Base Nos.) | Gene Encoded |
|---|---|
| 258..134 | attR1 |
| 367..1026 | CmR |
| 1146..1230 | inactivated ccdA |
| 1368..1673 | ccdB |
| 1714..1838 | attR2 |
| 2564..3421 | ampR |

```
   1 CGATCCCGCG AAATTAATAC GACTCACTAT AGGGAGACCA CAACGGTTTC CCTCTAGAAA
  61 TAATTTTGTT TAACTTTAAG AAGGAGATAT ACATATGTCG TACTACCATC ACCATCACCA
 121 TCACCTCGAA TCAACAAGTT TGTACAAAAA AGCTGAACGA GAAACGTAAA ATGATATAAA
 181 TATCAATATA TTAAATTAGA TTTTGCATAA AAAACAGACT ACATAATACT GTAAAACACA
 241 ACATATCCAG TCACTATGGC GGCCGCATTA GGCACCCCAG GCTTTACACT TTATGCTTCC
 301 GGCTCGTATA ATGTGTGGAT TTTGAGTTAG GATCCGTCGA GATTTTCAGG AGCTAAGGAA
 361 GCTAAAATGG AGAAAAAAAT CACTGGATAT ACCACCGTTG ATATATCCCA ATGGCATCGT
 421 AAAGAACATT TTGAGGCATT TCAGTCAGTT GCTCAATGTA CCTATAACCA GACCGTTCAG
 481 CTGGATATTA CGGCCTTTTT AAAGACCGTA AAGAAAAATA AGCACAAGTT TTATCCGGCC
 541 TTTATTCACA TTCTTGCCCG CCTGATGAAT GCTCATCCGG AATTCCGTAT GGCAATGAAA
 601 GACGGTGAGC TGGTGATATG GGATAGTGTT CACCCTTGTT ACACCGTTTT CCATGAGCAA
 661 ACTGAAACGT TTTCATCGCT CTGGAGTGAA TACCACGACG ATTTCCGGCA GTTTCTACAC
 721 ATATATTCGC AAGATGTGGC GTGTTACGGT GAAAACCTGG CCTATTTCCC TAAAGGGTTT
 781 ATTGAGAATA TGTTTTTCGT CTCAGCCAAT CCCTGGGTGA GTTTCACCAG TTTTGATTTA
 841 AACGTGGCCA ATATGGACAA CTTCTTCGCC CCCGTTTTCA CCATGGGCAA ATATTATACG
 901 CAAGGCGACA AGGTGCTGAT GCCGCTGGCG ATTCAGGTTC ATCATGCCGT CTGTGATGGC
 961 TTCCATGTCG GCAGAATGCT TAATGAATTA CAACAGTACT GCGATGAGTG GCAGGGCGGG
1021 GCGTAAAGAT CTGGATCCGG CTTACTAAAA GCCAGATAAC AGTATGCGTA TTTGCGCGCT
1081 GATTTTTGCG GTATAAGAAT ATATACTGAT ATGTATACCC GAAGTATGTC AAAAAGAGGT
1141 GTGCTATGAA GCAGCGTATT ACAGTGACAG TTGACAGCGA CAGCTATCAG TTGCTCAAGG
1201 CATATATGAT GTCAATATCT CCGGTCTGGT AAGCACAACC ATGCAGAATG AAGCCCGTCG
1261 TCTGCGTGCC GAACGCTGGA AAGCGGAAAA TCAGGAAGGG ATGGCTGAGG TCGCCCGGTT
1321 TATTGAAATG AACGGCTCTT TTGCTGACGA GAACAGGGAC TGGTGAAATG CAGTTTAAGG
1381 TTTACACCTA TAAAAGAGAG AGCCGTTATC GTCTGTTTGT GGATGTACAG AGTGATATTA
1441 TTGACACGCC CGGGCGACGG ATGGTGATCC CCCTGGCCAG TGCACGTCTG CTGTCAGATA
1501 AAGTCTCCCG TGAACTTTAC CCGGTGGTGC ATATCGGGGA TGAAAGCTGG CGCATGATGA
1561 CCACCGATAT GGCCAGTGTG CCGGTCTCCG TTATCGGGGA AGAAGTGGCT GATCTCAGCC
1621 ACCGCGAAAA TGACATCAAA AACGCCATTA ACCTGATGTT CTGGGGAATA TAAATGTCAG
1681 GCTCCCTTAT ACACAGCCAG TCTGCAGGTC GACCATAGTG ACTGGATATG TTGTGTTTTA
```

FIG.37B

```
1741 CAGTATTATG TAGTCTGTTT TTTATGCAAA ATCTAATTTA ATATATTGAT ATTTATATCA
1801 TTTTACGTTT CTCGTTCAGC TTTCTTGTAC AAAGTGGTTG ATTCGAGGCT GCTAACAAAG
1861 CCCGAAAGGA AGCTGAGTTG GCTGCTGCCA CCGCTGAGCA ATAACTAGCA TAACCCCTTG
1921 GGGCCTCTAA ACGGGTCTTG AGGGGTTTTT TGCTGAAAGG AGGAACTATA TCCGGATATC
1981 CACAGGACGG GTGTGGTCGC CATGATCGCG TAGTCGATAG TGGCTCCAAG TAGCGAAGCG
2041 AGCAGGACTG GGCGGCGGCC AAAGCGGTCG GACAGTGCTC CGAGAACGGG TGCGCATAGA
2101 AATTGCATCA ACGCATATAG CGCTAGCAGC ACGCCATAGT GACTGGCGAT GCTGTCGGAA
2161 TGGACGATAT CCCGCAAGAG GCCCGGCAGT ACCGGCATAA CCAAGCCTAT GCCTACAGCA
2221 TCCAGGGTGA CGGTGCCGAG GATGACGATG AGCGCATTGT TAGATTTCAT ACACGGTGCC
2281 TGACTGCGTT AGCAATTTAA CTGTGATAAA CTACCGCATT AAAGCTTATC GATGATAAGC
2341 TGTCAAACAT GAGAATTCTT GAAGACGAAA GGGCCTCGTG ATACGCCTAT TTTTATAGGT
2401 TAATGTCATG ATAATAATGG TTTCTTAGAC GTCAGGTGGC ACTTTTCGGG GAAATGTGCG
2461 CGGAACCCCT ATTTGTTTAT TTTTCTAAAT ACATTCAAAT ATGTATCCGC TCATGAGACA
2521 ATAACCCTGA TAAATGCTTC AATAATATTG AAAAAGGAAG AGTATGAGTA TTCAACATTT
2581 CCGTGTCGCC CTTATTCCCT TTTTTGCGGC ATTTTGCCTT CCTGTTTTTG CTCACCCAGA
2641 AACGCTGGTG AAAGTAAAAG ATGCTGAAGA TCAGTTGGGT GCACGAGTGG GTTACATCGA
2701 ACTGGATCTC AACAGCGGTA AGATCCTTGA GAGTTTTCGC CCCGAAGAAC GTTTTCCAAT
2761 GATGAGCACT TTTAAAGTTC TGCTATGTGG CGCGGTATTA TCCCGTGTTG ACGCCGGGCA
2821 AGAGCAACTC GGTCGCCGCA TACACTATTC TCAGAATGAC TTGGTTGAGT ACTCACCAGT
2881 CACAGAAAAG CATCTTACGG ATGGCATGAC AGTAAGAGAA TTATGCAGTG CTGCCATAAC
2941 CATGAGTGAT AACACTGCGG CCAACTTACT TCTGACAACG ATCGGAGGAC CGAAGGAGCT
3001 AACCGCTTTT TTGCACAACA TGGGGGATCA TGTAACTCGC CTTGATCGTT GGGAACCGGA
3061 GCTGAATGAA GCCATACCAA ACGACGAGCG TGACACCACG ATGCCTGCAG CAATGGCAAC
3121 AACGTTGCGC AAACTATTAA CTGGCGAACT ACTTACTCTA GCTTCCCGGC AACAATTAAT
3181 AGACTGGATG GAGGCGGATA AAGTTGCAGG ACCACTTCTG CGCTCGGCCC TTCCGGCTGG
3241 CTGGTTTATT GCTGATAAAT CTGGAGCCGG TGAGCGTGGG TCTCGCGGTA TCATTGCAGC
3301 ACTGGGGCCA GATGGTAAGC CCTCCCGTAT CGTAGTTATC TACACGACGG GGAGTCAGGC
3361 AACTATGGAT GAACGAAATA GACAGATCGC TGAGATAGGT GCCTCACTGA TTAAGCATTG
3421 GTAACTGTCA GACCAAGTTT ACTCATATAT ACTTTAGATT GATTTAAAAC TTCATTTTTA
3481 ATTTAAAAGG ATCTAGGTGA AGATCCTTTT TGATAATCTC ATGACCAAAA TCCCTTAACG
3541 TGAGTTTTCG TTCCACTGAG CGTCAGACCC CGTAGAAAAG ATCAAAGGAT CTTCTTGAGA
3601 TCCTTTTTTT CTGCGCGTAA TCTGCTGCTT GCAAACAAAA AAACCACCGC TACCAGCGGT
3661 GGTTTGTTTG CCGGATCAAG AGCTACCAAC TCTTTTTCCG AAGGTAACTG GCTTCAGCAG
3721 AGCGCAGATA CCAAATACTG TCCTTCTAGT GTAGCCGTAG TTAGGCCACC ACTTCAAGAA
3781 CTCTGTAGCA CCGCCTACAT ACCTCGCTCT GCTAATCCTG TTACCAGTGG CTGCTGCCAG
3841 TGGCGATAAG TCGTGTCTTA CCGGGTTGGA CTCAAGACGA TAGTTACCGG ATAAGGCGCA
3901 GCGGTCGGGC TGAACGGGGG GTTCGTGCAC ACAGCCCAGC TTGGAGCGAA CGACCTACAC
3961 CGAACTGAGA TACCTACAGC GTGAGCTATG AGAAAGCGCC ACGCTTCCCG AAGGGAGAAA
4021 GGCGGACAGG TATCCGGTAA GCGGCAGGGT CGGAACAGGA GAGCGCACGA GGGAGCTTCC
```

FIG.37C

```
4081 AGGGGGAAAC GCCTGGTATC TTTATAGTCC TGTCGGGTTT CGCCACCTCT GACTTGAGCG
4141 TCGATTTTTG TGATGCTCGT CAGGGGGGCG GAGCCTATGG AAAAACGCCA GCAACGCGGC
4201 CTTTTTACGG TTCCTGGCCT TTTGCTGGCC TTTTGCTCAC ATGTTCTTTC CTGCGTTATC
4261 CCCTGATTCT GTGGATAACC GTATTACCGC CTTTGAGTGA GCTGATACCG CTCGCCGCAG
4321 CCGAACGACC GAGCGCAGCG AGTCAGTGAG CGAGGAAGCG GAAGAGCGCC TGATGCGGTA
4381 TTTTCTCCTT ACGCATCTGT GCGGTATTTC ACACCGCATA TATGGTGCAC TCTCAGTACA
4441 ATCTGCTCTG ATGCCGCATA GTTAAGCCAG TATACACTCC GCTATCGCTA CGTGACTGGG
4501 TCATGGCTGC GCCCCGACAC CCGCCAACAC CCGCTGACGC GCCCTGACGG GCTTGTCTGC
4561 TCCCGGCATC CGCTTACAGA CAAGCTGTGA CCGTCTCCGG GAGCTGCATG TGTCAGAGGT
4621 TTTCACCGTC ATCACCGAAA CGCGCGAGGC AGCTGCGGTA AAGCTCATCA GCGTGGTCGT
4681 GAAGCGATTC ACAGATGTCT GCCTGTTCAT CCGCGTCCAG CTCGTTGAGT TTCTCCAGAA
4741 GCGTTAATGT CTGGCTTCTG ATAAAGCGGG CCATGTTAAG GGCGGTTTTT TCCTGTTTGG
4801 TCACTGATGC CTCCGTGTAA GGGGGATTTC TGTTCATGGG GGTAATGATA CCGATGAAAC
4861 GAGAGAGGAT GCTCACGATA CGGGTTACTG ATGATGAACA TGCCCGGTTA CTGGAACGTT
4921 GTGAGGGTAA ACAACTGGCG GTATGGATGC GGCGGGACCA GAGAAAAATC ACTCAGGGTC
4981 AATGCCAGCG CTTCGTTAAT ACAGATGTAG GTGTTCCACA GGGTAGCCAG CAGCATCCTG
5041 CGATGCAGAT CCGGAACATA ATGGTGCAGG GCGCTGACTT CCGCGTTTCC AGACTTTACG
5101 AAACACGGAA ACCGAAGACC ATTCATGTTG TTGCTCAGGT CGCAGACGTT TTGCAGCAGC
5161 AGTCGCTTCA CGTTCGCTCG CGTATCGGTG ATTCATTCTG CTAACCAGTA AGGCAACCCC
5221 GCCAGCCTAG CCGGGTCCTC AACGACAGGA GCACGATCAT GCGCACCCGT GGCCAGGACC
5281 CAACGCTGCC CGAGATGCGC CGCGTGCGGC TGCTGGAGAT GGCGGACGCG ATGGATATGT
5341 TCTGCCAAGG GTTGGTTTGC GCATTCACAG TTCTCCGCAA GAATTGATTG GCTCCAATTC
5401 TTGGAGTGGT GAATCCGTTA GCGAGGTGCC GCCGGCTTCC ATTCAGGTCG AGGTGGCCCG
5461 GCTCCATGCA CCGCGACGCA ACGCGGGGAG GCAGACAAGG TATAGGGCGG CGCCTACAAT
5521 CCATGCCAAC CCGTTCCATG TGCTCGCCGA GGCGGCATAA ATCGCCGTGA CGATCAGCGG
5581 TCCAGTGATC GAAGTTAGGC TGGTAAGAGC CGCGAGCGAT CCTTGAAGCT GTCCCTGATG
5641 GTCGTCATCT ACCTGCCTGG ACAGCATGGC CTGCAACGCG GGCATCCCGA TGCCGCCGGA
5701 AGCGAGAAGA ATCATAATGG GGAAGGCCAT CCAGCCTCGC GTCGCGAACG CCAGCAAGAC
5761 GTAGCCCAGC GCGTCGGCCG CCATGCCGGC GATAATGGCC TGCTTCTCGC CGAAACGTTT
5821 GGTGGCGGGA CCAGTGACGA AGGCTTGAGC GAGGGCGTGC AAGATTCCGA ATACCGCAAG
5881 CGACAGGCCG ATCATCGTCG CGCTCCAGCG AAAGCGGTCC TCGCCGAAAA TGACCCAGAG
5941 CGCTGCCGGC ACCTGTCCTA CGAGTTGCAT GATAAAGAAG ACAGTCATAA GTGCGGCGAC
6001 GATAGTCATG CCCCGCGCCC ACCGGAAGGA GCTGACTGGG TTGAAGGCTC TCAAGGGCAT
6061 CGGTCGATCG ACGCTCTCCC TTATGCGACT CCTGCATTAG GAAGCAGCCC AGTAGTAGGT
6121 TGAGGCCGTT GAGCACCGCC GCCGCAAGGA ATGGTGCATG CAAGGAGATG GCGCCCAACA
6181 GTCCCCCGGC CACGGGGCCT GCCACCATAC CCACGCCGAA ACAAGCGCTC ATGAGCCCGA
6241 AGTGGCGAGC CCGATCTTCC CCATCGGTGA TGTCGGCGAT ATAGGCGCCA GCAACCGCAC
6301 CTGTGGCGCC GGTGATGCCG GCCACGATGC GTCCGGCGTA GAGGATCGAG ATCT
```

FIG.37D

FastBac Transfer Vector with p10 Baculovirus Promoter

```
  1  gaagacctcg gccgtcgcgg cgcttgccgg tggtgctgac cccggatgaa gtggttcgca
     cttctggagc cggcagcgcc gcgaacggcc accacgactg gggcctactt caccaagcgt 61  tcctcggttt tctggaaggc gagcatcgtt tgttcgccca ggactctagc tatagttcta
     aggagccaaa agaccttccg ctcgtagcaa acaagcgggt cctgagatcg atatcaagat 121  gtggttggct acgtatcgag caagaaaata aaacgccaaa cgcgttggag tcttgtgtgc
     caccaaccga tgcatagctc gttctttat ttgcggttt gcgcaacctc agaacacacg
                                    p10 Promoter 181  tattttaca aagattcaga aatacgcatc acttacaaca agggggacta tgaaattatg
     ataaaatgt ttctaagtct ttatgcgtag tgaatgttgt tccccctgat acttaatac 241  cattgagg atgccgggac cttaattca acccaacaca atatattata gttaaataag  mRNA
     gtaaactcc tacggccctg gaattaagt tgggttgtgt tatataatat caatttattc 301  aattatttat caaatcattt gtatattaat taaaatacta tactgtaaat tacatttat
     ttaataaata gtttagtaaa catataatta attttatgat atgacattta atgtaaaata 361  ttacaatgag gatcatcaca agtttgtaca aaaaagctga acgagaaacg taaaatgata
     aatgttactc ctagtagtgt tcaaacatgt ttttcgact tgctctttgc atttactat
                          ....Int       attR1
```

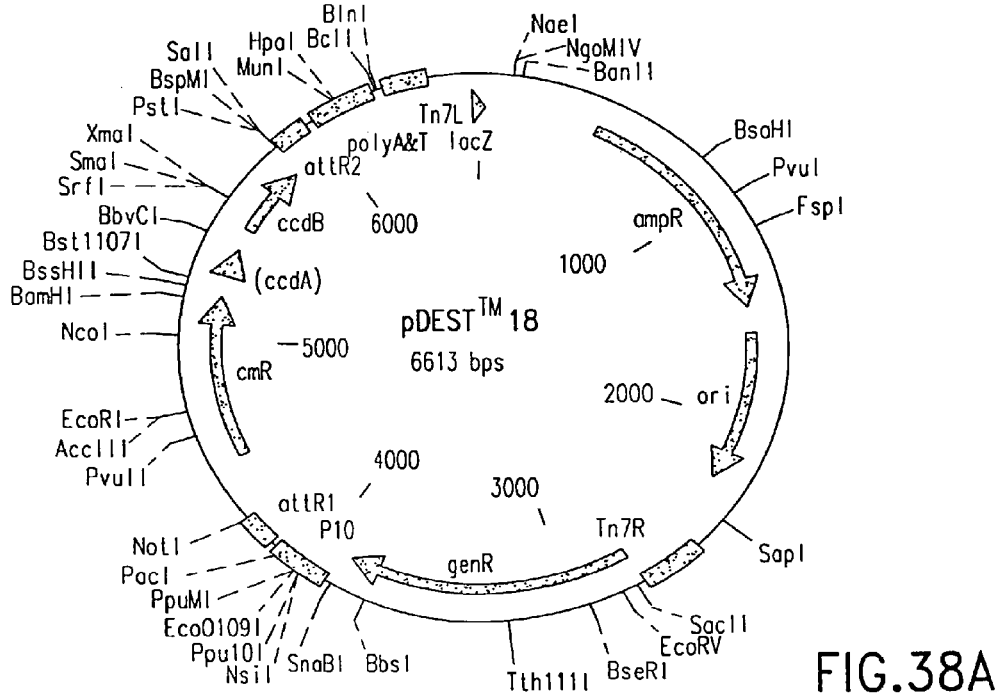

FIG.38A pDEST18 6613 bp

| Location (Base Nos.) | Gene Encoded |
|---|---|
| 474..1449 | ampR |
| 1590..2244 | ori |
| 2738..3850 | genR |
| 4251..4127 | attR1 |
| 4501..5160 | CmR |
| 5280..5364 | inactivated ccdA |
| 5502..5807 | ccdB |
| 5848..5972 | attR2 |
| 6595..25 | lacZ |

```
   1 GACGCGCCCT GTAGCGGCGC ATTAAGCGCG GCGGGTGTGG TGGTTACGCG CAGCGTGACC
  61 GCTACACTTG CCAGCGCCCT AGCGCCCGCT CCTTTCGCTT TCTTCCCTTC CTTTCTCGCC
 121 ACGTTCGCCG GCTTTCCCCG TCAAGCTCTA AATCGGGGGC TCCCTTTAGG GTTCCGATTT
 181 AGTGCTTTAC GGCACCTCGA CCCCAAAAAA CTTGATTAGG GTGATGGTTC ACGTAGTGGG
 241 CCATCGCCCT GATAGACGGT TTTTCGCCCT TTGACGTTGG AGTCCACGTT CTTTAATAGT
 301 GGACTCTTGT TCCAAACTGG AACAACACTC AACCCTATCT CGGTCTATTC TTTTGATTTA
 361 TAAGGGATTT TGCCGATTTC GGCCTATTGG TTAAAAAATG AGCTGATTTA ACAAAAATTT
 421 AACGCGAATT TTAACAAAAT ATTAACGTTT ACAATTTCAG GTGGCACTTT TCGGGGAAAT
 481 GTGCGCGGAA CCCCTATTTG TTTATTTTTC TAAATACATT CAAATATGTA TCCGCTCATG
 541 AGACAATAAC CCTGATAAAT GCTTCAATAA TATTGAAAAA GGAAGAGTAT GAGTATTCAA
 601 CATTTCCGTG TCGCCCTTAT TCCCTTTTTT GCGGCATTTT GCCTTCCTGT TTTTGCTCAC
 661 CCAGAAACGC TGGTGAAAGT AAAAGATGCT GAAGATCAGT TGGGTGCACG AGTGGGTTAC
 721 ATCGAACTGG ATCTCAACAG CGGTAAGATC CTTGAGAGTT TTCGCCCCGA AGAACGTTTT
 781 CCAATGATGA GCACTTTTAA AGTTCTGCTA TGTGGCGCGG TATTATCCCG TATTGACGCC
 841 GGGCAAGAGC AACTCGGTCG CCGCATACAC TATTCTCAGA ATGACTTGGT TGAGTACTCA
 901 CCAGTCACAG AAAAGCATCT TACGGATGGC ATGACAGTAA GAGAATTATG CAGTGCTGCC
 961 ATAACCATGA GTGATAACAC TGCGGCCAAC TTACTTCTGA CAACGATCGG AGGACCGAAG
1021 GAGCTAACCG CTTTTTTGCA CAACATGGGG GATCATGTAA CTCGCCTTGA TCGTTGGGAA
1081 CCGGAGCTGA ATGAAGCCAT ACCAAACGAC GAGCGTGACA CCACGATGCC TGTAGCAATG
1141 GCAACAACGT TGCGCAAACT ATTAACTGGC GAACTACTTA CTCTAGCTTC CCGGCAACAA
1201 TTAATAGACT GGATGGAGGC GGATAAAGTT GCAGGACCAC TTCTGCGCTC GGCCCTTCCG
1261 GCTGGCTGGT TTATTGCTGA TAAATCTGGA GCCGGTGAGC GTGGGTCTCG CGGTATCATT
1321 GCAGCACTGG GGCCAGATGG TAAGCCCTCC CGTATCGTAG TTATCTACAC GACGGGGAGT
1381 CAGGCAACTA TGGATGAACG AAATAGACAG ATCGCTGAGA TAGGTGCCTC ACTGATTAAG
1441 CATTGGTAAC TGTCAGACCA AGTTTACTCA TATATACTTT AGATTGATTT AAAACTTCAT
1501 TTTTAATTTA AAAGGATCTA GGTGAAGATC CTTTTTGATA ATCTCATGAC CAAAATCCCT
1561 TAACGTGAGT TTTCGTTCCA CTGAGCGTCA GACCCCGTAG AAAAGATCAA AGGATCTTCT
1621 TGAGATCCTT TTTTTCTGCG CGTAATCTGC TGCTTGCAAA CAAAAAAACC ACCGCTACCA
1681 GCGGTGGTTT GTTTGCCGGA TCAAGAGCTA CCAACTCTTT TTCCGAAGGT AACTGGCTTC
1741 AGCAGAGCGC AGATACCAAA TACTGTCCTT CTAGTGTAGC CGTAGTTAGG CCACCACTTC
```

FIG.38B

```
1801 AAGAACTCTG TAGCACCGCC TACATACCTC GCTCTGCTAA TCCTGTTACC AGTGGCTGCT
1861 GCCAGTGGCG ATAAGTCGTG TCTTACCGGG TTGGACTCAA GACGATAGTT ACCGGATAAG
1921 GCGCAGCGGT CGGGCTGAAC GGGGGGTTCG TGCACACAGC CCAGCTTGGA GCGAACGACC
1981 TACACCGAAC TGAGATACCT ACAGCGTGAG CATTGAGAAA GCGCCACGCT TCCCGAAGGG
2041 AGAAAGGCGG ACAGGTATCC GGTAAGCGGC AGGGTCGGAA CAGGAGAGCG CACGAGGGAG
2101 CTTCCAGGGG GAAACGCCTG GTATCTTTAT AGTCCTGTCG GGTTTCGCCA CCTCTGACTT
2161 GAGCGTCGAT TTTTGTGATG CTCGTCAGGG GGGCGGAGCC TATGGAAAAA CGCCAGCAAC
2221 GCGGCCTTTT TACGGTTCCT GGCCTTTTGC TGGCCTTTTG CTCACATGTT CTTTCCTGCG
2281 TTATCCCCTG ATTCTGTGGA TAACCGTATT ACCGCCTTTG AGTGAGCTGA TACCGCTCGC
2341 CGCAGCCGAA CGACCGAGCG CAGCGAGTCA GTGAGCGAGG AAGCGGAAGA GCGCCTGATG
2401 CGGTATTTTC TCCTTACGCA TCTGTGCGGT ATTTCACACC GCAGACCAGC CGCGTAACCT
2461 GGCAAAATCG GTTACGGTTG AGTAATAAAT GGATGCCCTG CGTAAGCGGG TGTGGGCGGA
2521 CAATAAAGTC TTAAACTGAA CAAAATAGAT CTAAACTATG ACAATAAAGT CTTAAACTAG
2581 ACAGAATAGT TGTAAACTGA AATCAGTCCA GTTATGCTGT GAAAAAGCAT ACTGGACTTT
2641 TGTTATGGCT AAAGCAAACT CTTCATTTTC TGAAGTGCAA ATTGCCCGTC GTATTAAAGA
2701 GGGGCGTGGC CAAGGGCATG GTAAAGACTA TATTCGCGGC GTTGTGACAA TTTACCGAAC
2761 AACTCCGCGG CCGGGAAGCC GATCTCGGCT TGAACGAATT GTTAGGTGGC GGTACTTGGG
2821 TCGATATCAA AGTGCATCAC TTCTTCCCGT ATGCCCAACT TTGTATAGAG AGCCACTGCG
2881 GGATCGTCAC CGTAATCTGC TTGCACGTAG ATCACATAAG CACCAAGCGC GTTGGCCTCA
2941 TGCTTGAGGA GATTGATGAG CGCGGTGGCA ATGCCCTGCC TCCGGTGCTC GCCGGAGACT
3001 GCGAGATCAT AGATATAGAT CTCACTACGC GGCTGCTCAA ACCTGGGCAG AACGTAAGCC
3061 GCGAGAGCGC CAACAACCGC TTCTTGGTCG AAGGCAGCAA GCGCGATGAA TGTCTTACTA
3121 CGGAGCAAGT TCCCGAGGTA ATCGGAGTCC GGCTGATGTT GGGAGTAGGT GGCTACGTCT
3181 CCGAACTCAC GACCGAAAAG ATCAAGAGCA GCCCGCATGG ATTTGACTTG GTCAGGGCCG
3241 AGCCTACATG TGCGAATGAT GCCCATACTT GAGCCACCTA ACTTTGTTTT AGGGCGACTG
3301 CCCTGCTGCG TAACATCGTT GCTGCTGCGT AACATCGTTG CTGCTCCATA ACATCAAACA
3361 TCGACCCACG GCGTAACGCG CTTGCTGCTT GGATGCCCGA GGCATAGACT GTACAAAAAA
3421 ACAGTCATAA CAAGCCATGA AAACCGCCAC TGCGCCGTTA CCACCGCTGC GTTCGGTCAA
3481 GGTTCTGGAC CAGTTGCGTG AGCGCATACG CTACTTGCAT TACAGTTTAC GAACCGAACA
3541 GGCTTATGTC AACTGGGTTC GTGCCTTCAT CCGTTTCCAC GGTGTGCGTC ACCCGGCAAC
3601 CTTGGGCAGC AGCGAAGTCG AGGCATTTCT GTCCTGGCTG GCGAACGAGC GCAAGGTTTC
3661 GGTCTCCACG CATCGTCAGG CATTGGCGGC CTTGCTGTTC TTCTACGGCA AGGTGCTGTG
3721 CACGGATCTG CCCTGGCTTC AGGAGATCGG AAGACCTCGG CCGTCGCGGC GCTTGCCGGT
3781 GGTGCTGACC CCGGATGAAG TGGTTCGCAT CCTCGGTTTT CTGGAAGGCG AGCATCGTTT
3841 GTTCGCCCAG GACTCTAGCT ATAGTTCTAG TGGTTGGCTA CGTATCGAGC AAGAAAATAA
3901 AACGCCAAAC GCGTTGGAGT CTTGTGTGCT ATTTTTACAA AGATTCAGAA ATACGCATCA
3961 CTTACAACAA GGGGGACTAT GAAATTATGC ATTTTGAGGA TGCCGGGACC TTTAATTCAA
4021 CCCAACACAA TATATTATAG TTAAATAAGA ATTATTTATC AAATCATTTG TATATTAATT
4081 AAAATACTAT ACTGTAAATT ACATTTTATT TACAATGAGG ATCATCACAA GTTTGTACAA
4141 AAAAGCTGAA CGAGAAACGT AAAATGATAT AAATATCAAT ATATTAAATT AGATTTTGCA
4201 TAAAAAACAG ACTACATAAT ACTGTAAAAC ACAACATATC CAGTCACTAT GGCGGCCGCT
4261 AAGTTGGCAG CATCACCCGA CGCACTTTGC GCCGAATAAA TACCTGTGAC GGAAGATCAC
4321 TTCGCAGAAT AAATAAATCC TGGTGTCCCT GTTGATACCG GAAGCCCTG GGCCAACTTT
```

FIG.38C

```
4381 TGGCGAAAAT GAGACGTTGA TCGGCACGTA AGAGGTTCCA ACTTTCACCA TAATGAAATA
4441 AGATCACTAC CGGGCGTATT TTTTGAGTTA TCGAGATTTT CAGGAGCTAA GGAAGCTAAA
4501 ATGGAGAAAA AAATCACTGG ATATACCACC GTTGATATAT CCCAATGGCA TCGTAAAGAA
4561 CATTTTGAGG CATTTCAGTC AGTTGCTCAA TGTACCTATA ACCAGACCGT TCAGCTGGAT
4621 ATTACGGCCT TTTTAAAGAC CGTAAAGAAA AATAAGCACA AGTTTTATCC GGCCTTTATT
4681 CACATTCTTG CCCGCCTGAT GAATGCTCAT CCGGAATTCC GTATGGCAAT GAAAGACGGT
4741 GAGCTGGTGA TATGGGATAG TGTTCACCCT TGTTACACCG TTTTCCATGA GCAAACTGAA
4801 ACGTTTTCAT CGCTCTGGAG TGAATACCAC GACGATTTCC GGCAGTTTCT ACACATATAT
4861 TCGCAAGATG TGGCGTGTTA CGGTGAAAAC CTGGCCTATT TCCCTAAAGG GTTTATTGAG
4921 AATATGTTTT TCGTCTCAGC CAATCCCTGG GTGAGTTTCA CCAGTTTTGA TTTAAACGTG
4981 GCCAATATGG ACAACTTCTT CGCCCCCGTT TTCACCATGG GCAAATATTA TACGCAAGGC
5041 GACAAGGTGC TGATGCCGCT GGCGATTCAG GTTCATCATG CCGTCTGTGA TGGCTTCCAT
5101 GTCGGCAGAA TGCTTAATGA ATTACAACAG TACTGCGATG AGTGGCAGGG CGGGGCGTAA
5161 ACGCGTGGAT CCGGCTTACT AAAAGCCAGA TAACAGTATG CGTATTTGCG CGCTGATTTT
5221 TGCGGTATAA GAATATATAC TGATATGTAT ACCCGAAGTA TGTCAAAAAG AGGTGTGCTA
5281 TGAAGCAGCG TATTACAGTG ACAGTTGACA GCGACAGCTA TCAGTTGCTC AAGGCATATA
5341 TGATGTCAAT ATCTCCGGTC TGGTAAGCAC AACCATGCAG AATGAAGCCC GTCGTCTGCG
5401 TGCCGAACGC TGGAAAGCGG AAAATCAGGA AGGGATGGCT GAGGTCGCCC GGTTTATTGA
5461 AATGAACGGC TCTTTTGCTG ACGAGAACAG GGACTGGTGA AATGCAGTTT AAGGTTTACA
5521 CCTATAAAAG AGAGAGCCGT TATCGTCTGT TTGTGGATGT ACAGAGTGAT ATTATTGACA
5581 CGCCCGGGCG ACGGATGGTG ATCCCCCTGG CCAGTGCACG TCTGCTGTCA GATAAAGTCT
5641 CCCGTGAACT TTACCCGGTG GTGCATATCG GGGATGAAAG CTGGCGCATG ATGACCACCG
5701 ATATGGCCAG TGTGCCGGTC TCCGTTATCG GGGAAGAAGT GGCTGATCTC AGCCACCGCG
5761 AAAATGACAT CAAAAACGCC ATTAACCTGA TGTTCTGGGG AATATAAATG TCAGGCTCCC
5821 TTATACACAG CCAGTCTGCA GGTCGACCAT AGTGACTGGA TATGTTGTGT TTTACAGTAT
5881 TATGTAGTCT GTTTTTTATG CAAAATCTAA TTTAATATAT TGATATTTAT ATCATTTTAC
5941 GTTTCTCGTT CAGCTTTCTT GTACAAAGTG GTGATAGCTT GTCGAGAAGT ACTAGAGGAT
6001 CATAATCAGC CATACCACAT TTGTAGAGGT TTTACTTGCT TTAAAAAACC TCCCACACCT
6061 CCCCCTGAAC CTGAAACATA AAATGAATGC AATTGTTGTT GTTAACTTGT TTATTGCAGC
6121 TTATAATGGT TACAAATAAA GCAATAGCAT CACAAATTTC ACAAATAAAG CATTTTTTTC
6181 ACTGCATTCT AGTTGTGGTT TGTCCAAACT CATCAATGTA TCTTATCATG TCTGGATCTG
6241 ATCACTGCTT GAGCCTAGGA GATCCGAACC AGATAAGTGA AATCTAGTTC CAAACTATTT
6301 TGTCATTTTT AATTTTCGTA TTAGCTTACG ACGCTACACC CAGTTCCCAT CTATTTTGTC
6361 ACTCTTCCCT AAATAATCCT TAAAAACTCC ATTTCCACCC CTCCCAGTTC CCAACTATTT
6421 TGTCCGCCCA CAGCGGGGCA TTTTTCTTCC TGTTATGTTT TTAATCAAAC ATCCTGCCAA
6481 CTCCATGTGA CAAACCGTCA TCTTCGGCTA CTTTTTCTCT GTCACAGAAT GAAAATTTTT
6541 CTGTCATCTC TTCGTTATTA ATGTTTGTAA TTGACTGAAT ATCAACGCTT ATTTGCAGCC
6601 TGAATGGCGA ATG
```

FIG. 38D

FastBac Transfer Vector with 39K Baculovirus Promoter

```
  1 ggtgacgccg tcatctttcc attgtaacgt aaatggcaac ttgtagatga acgcgctgtc
    ccactgcggc agtagaaagg taacattgca tttaccgttg aacatctact tgcgcgacag 61 aaaaaaccgg ccagtttctt ccacaaactc gcgcacggct gtctcgtaaa cttttgcgtc
    ttttttggcc ggtcaaagaa ggtgtttgag cgcgtgccga cagagcattt gaaaacgcag
                                                39K Promoter
121 gcaacaatcg cgatgacctc gtggtatgga aattttttct aaaaaagtgt cgttcatgtc
    cgttgttagc gctactggag caccatacct ttaaaaaaga ttttttcaca gcaagtacag 181 ggcggcggcg ttcgcgctcc ggtacgcgcg acgggcacac agcaggacag ccttgtccgg
    ccgccgccgc aagcgcgagg ccatgcgcgc tgcccgtgtg tcgtcctgtc ggaacaggcc
                                                             attR1
241 ctcgattatc ataacaatc ctgcaggcat gcaagctgga tcatcacaag tttgtacaaa
    gagctaatag tatttgttag gacgtccgta cgttcgacct agtagtgttc aaacatgttt
                                                                  Int
```

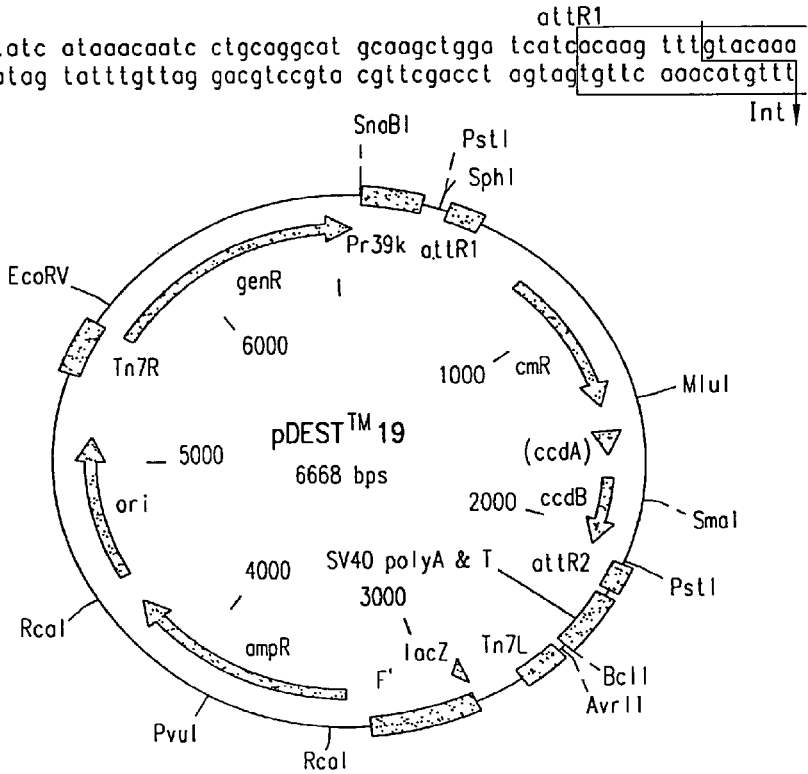

FIG.39A pDEST19 6668 bp (rotated to position 1000)

| Location (Base Nos.) | Gene Encoded |
|---|---|
| 515..391 | attR1 |
| 765..1424 | CmR |
| 1544..1628 | inactivated ccdA |
| 1766..2071 | ccdB |
| 2112..2236 | attR2 |
| 2852..2895 | lacZ |
| 3344..4319 | ampR |
| 4460..5114 | ori |
| 5608..52 | genR |

```
   1 AGTGGTTCGC ATCCTCGGTT TTCTGGAAGG CGAGCATCGT TTGTTCGCCC AGGACTCTAG
  61 CTATAGTTCT AGTGGTTGGC TACGTATATC AAATACTTGT AGGTGACGCC GTCATCTTTC
 121 CATTGTAACG TAAATGGCAA CTTGTAGATG AACGCGCTGT CAAAAAACCG GCCAGTTTCT
 181 TCCACAAACT CGCGCACGGC TGTCTCGTAA ACTTTTGCGT CGCAACAATC GCGATGACCT
 241 CGTGGTATGG AAATTTTTTC TAAAAAAGTG TCGTTCATGT CGGCGGCGGG CGCGTTCGCG
 301 CTCCGGTACG CGCGACGGGC ACACAGCAGG ACAGCCTTGT CCGGCTCGAT TATCATAAAC
 361 AATCCTGCAG GCATGCAAGC TCGGATCATC ACAAGTTTGT ACAAAAAAGC TGAACGAGAA
 421 ACGTAAAATG ATATAAATAT CAATATATTA AATTAGATTT TGCATAAAAA ACAGACTACA
 481 TAATACTGTA AAACACAACA TATCCAGTCA CTATGGCGGC CGCTAAGTTG GCAGCATCAC
 541 CCGACGCACT TTGCGCCGAA TAAATACCTG TGACGGAAGA TCACTTCGCA GAATAAATAA
 601 ATCCTGGTGT CCCTGTTGAT ACCGGGAAGC CCTGGGCCAA CTTTTGGCGA AAATGAGACG
 661 TTGATCGGCA CGTAAGAGGT TCCAACTTTC ACCATAATGA AATAAGATCA CTACCGGGCG
 721 TATTTTTTGA GTTATCGAGA TTTTCAGGAG CTAAGGAAGC TAAAATGGAG AAAAAAATCA
 781 CTGGATATAC CACCGTTGAT ATATCCCAAT GGCATCGTAA AGAACATTTT GAGGCATTTC
 841 AGTCAGTTGC TCAATGTACC TATAACCAGA CCGTTCAGCT GGATATTACG GCCTTTTTAA
 901 AGACCGTAAA GAAAAATAAG CACAAGTTTT ATCCGGCCTT TATTCACATT CTTGCCCGCC
 961 TGATGAATGC TCATCCGGAA TTCCGTATGG CAATGAAAGA CGGTGAGCTG GTGATATGGG
1021 ATAGTGTTCA CCCTTGTTAC ACCGTTTTCC ATGAGCAAAC TGAAACGTTT TCATCGCTCT
1081 GGAGTGAATA CCACGACGAT TTCCGGCAGT TTCTACACAT ATATTCGCAA GATGTGGCGT
1141 GTTACGGTGA AAACCTGGCC TATTTCCCTA AAGGGTTTAT TGAGAATATG TTTTTCGTCT
1201 CAGCCAATCC CTGGGTGAGT TTCACCAGTT TTGATTTAAA CGTGGCCAAT ATGGACAACT
1261 TCTTCGCCCC CGTTTTCACC ATGGGCAAAT ATTATACGCA AGGCGACAAG GTGCTGATGC
1321 CGCTGGCGAT TCAGGTTCAT CATGCCGTCT GTGATGGCTT CCATGTCGGC AGAATGCTTA
1381 ATGAATTACA ACAGTACTGC GATGAGTGGC AGGGCGGGGC GTAAACGCGT GGATCCGGCT
1441 TACTAAAAGC CAGATAACAG TATGCGTATT TGCGCGCTGA TTTTTGCGGT ATAAGAATAT
1501 ATACTGATAT GTATACCCGA AGTATGTCAA AAAGAGGTGT GCTATGAAGC AGCGTATTAC
1561 AGTGACAGTT GACAGCGACA GCTATCAGTT GCTCAAGGCA TATATGATGT CAATATCTCC
1621 GGTCTGGTAA GCACAACCAT GCAGAATGAA GCCCGTCGTC TGCGTGCCGA ACGCTGGAAA
1681 GCGGAAAATC AGGAAGGGAT GGCTGAGGTC GCCCGGTTTA TTGAAATGAA CGGCTCTTTT
1741 GCTGACGAGA ACAGGGACTG GTGAAATGCA GTTTAAGGTT TACACCTATA AAGAGAGAG
1801 CCGTTATCGT CTGTTTGTGG ATGTACAGAG TGATATTATT GACACGCCCG GGCGACGGAT
1861 GGTGATCCCC CTGGCCAGTG CACGTCTGCT GTCAGATAAA GTCTCCCGTG AACTTTACCC
```

FIG.39B

```
1921 GGTGGTGCAT ATCGGGGATG AAAGCTGGCG CATGATGACC ACCGATATGG CCAGTGTGCC
1981 GGTCTCCGTT ATCGGGGAAG AAGTGGCTGA TCTCAGCCAC CGCGAAAATG ACATCAAAAA
2041 CGCCATTAAC CTGATGTTCT GGGGAATATA AATGTCAGGC TCCCTTATAC ACAGCCAGTC
2101 TGCAGGTCGA CCATAGTGAC TGGATATGTT GTGTTTTACA GTATTATGTA GTCTGTTTTT
2161 TATGCAAAAT CTAATTTAAT ATATTGATAT TTATATCATT TTACGTTTCT CGTTCAGCTT
2221 TCTTGTACAA AGTGGTGATC GAGAAGTACT AGAGGATCAT AATCAGCCAT ACCACATTTG
2281 TAGAGGTTTT ACTTGCTTTA AAAAACCTCC CACACCTCCC CCTGAACCTG AAACATAAAA
2341 TGAATGCAAT TGTTGTTGTT AACTTGTTTA TTGCAGCTTA TAATGGTTAC AAATAAAGCA
2401 ATAGCATCAC AAATTTCACA AATAAAGCAT TTTTTTCACT GCATTCTAGT TGTGGTTTGT
2461 CCAAACTCAT CAATGTATCT TATCATGTCT GGATCTGATC ACTGCTTGAG CCTAGGAGAT
2521 CCGAACCAGA TAAGTGAAAT CTAGTTCCAA ACTATTTTGT CATTTTTAAT TTTCGTATTA
2581 GCTTACGACG CTACACCCAG TTCCCATCTA TTTTGTCACT CTTCCCTAAA TAATCCTTAA
2641 AAACTCCATT TCCACCCCTC CCAGTTCCCA ACTATTTTGT CCGCCACAG CGGGGCATTT
2701 TTCTTCCTGT TATGTTTTTA ATCAAACATC CTGCCAACTC CATGTGACAA ACCGTCATCT
2761 TCGGCTACTT TTTCTCTGTC ACAGAATGAA AATTTTTCTG TCATCTCTTC GTTATTAATG
2821 TTTGTAATTG ACTGAATATC AACGCTTATT TGCAGCCTGA ATGGCGAATG GACGCGCCCT
2881 GTAGCGGCGC ATTAAGCGCG GCGGGTGTGG TGGTTACGCG CAGCGTGACC GCTACACTTG
2941 CCAGCGCCCT AGCGCCCGCT CCTTTCGCTT TCTTCCCTTC CTTTCTCGCC ACGTTCGCCG
3001 GCTTTCCCCG TCAAGCTCTA AATCGGGGGC TCCCTTTAGG GTTCCGATTT AGTGCTTTAC
3061 GGCACCTCGA CCCCAAAAAA CTTGATTAGG GTGATGGTTC ACGTAGTGGG CCATCGCCCT
3121 GATAGACGGT TTTTCGCCCT TTGACGTTGG AGTCCACGTT CTTTAATAGT GGACTCTTGT
3181 TCCAAACTGG AACAACACTC AACCCTATCT CGGTCTATTC TTTTGATTTA TAAGGGATTT
3241 TGCCGATTTC GGCCTATTGG TTAAAAAATG AGCTGATTTA ACAAAATTT AACGCGAATT
3301 TTAACAAAAT ATTAACGTTT ACAATTTCAG GTGGCACTTT TCGGGGAAAT GTGCGCGGAA
3361 CCCCTATTTG TTTATTTTTC TAAATACATT CAAATATGTA TCCGCTCATG AGACAATAAC
3421 CCTGATAAAT GCTTCAATAA TATTGAAAAA GGAAGAGTAT GAGTATTCAA CATTTCCGTG
3481 TCGCCCTTAT TCCCTTTTTT GCGGCATTTT GCCTTCCTGT TTTTGCTCAC CCAGAAACGC
3541 TGGTGAAAGT AAAAGATGCT GAAGATCAGT TGGGTGCACG AGTGGGTTAC ATCGAACTGG
3601 ATCTCAACAG CGGTAAGATC CTTGAGAGTT TTCGCCCCGA AGAACGTTTT CCAATGATGA
3661 GCACTTTTAA AGTTCTGCTA TGTGGCGCGG TATTATCCCG TATTGACGCC GGGCAAGAGC
3721 AACTCGGTCG CCGCATACAC TATTCTCAGA ATGACTTGGT TGAGTACTCA CCAGTCACAG
3781 AAAAGCATCT TACGGATGGC ATGACAGTAA GAGAATTATG CAGTGCTGCC ATAACCATGA
3841 GTGATAACAC TGCGGCCAAC TTACTTCTGA CAACGATCGG AGGACCGAAG GAGCTAACCG
3901 CTTTTTTGCA CAACATGGGG GATCATGTAA CTCGCCTTGA TCGTTGGGAA CCGGAGCTGA
3961 ATGAAGCCAT ACCAAACGAC GAGCGTGACA CCACGATGCC TGTAGCAATG GCAACAACGT
4021 TGCGCAAACT ATTAACTGGC GAACTACTTA CTCTAGCTTC CCGGCAACAA TTAATAGACT
4081 GGATGGAGGC GGATAAAGTT GCAGGACCAC TTCTGCGCTC GGCCCTTCCG GCTGGCTGGT
4141 TTATTGCTGA TAAATCTGGA GCCGGTGAGC GTGGGTCTCG CGGTATCATT GCAGCACTGG
4201 GGCCAGATGG TAAGCCCTCC CGTATCGTAG TTATCTACAC GACGGGGAGT CAGGCAACTA
4261 TGGATGAACG AAATAGACAG ATCGCTGAGA TAGGTGCCTC ACTGATTAAG CATTGGTAAC
4321 TGTCAGACCA AGTTTACTCA TATATACTTT AGATTGATTT AAAACTTCAT TTTTAATTTA
4381 AAAGGATCTA GGTGAAGATC CTTTTTGATA ATCTCATGAC CAAAATCCCT TAACGTGAGT
4441 TTTCGTTCCA CTGAGCGTCA GACCCCGTAG AAAAGATCAA AGGATCTTCT TGAGATCCTT
```

FIG.39C

```
4501 TTTTTCTGCG CGTAATCTGC TGCTTGCAAA CAAAAAAACC ACCGCTACCA GCGGTGGTTT
4561 GTTTGCCGGA TCAAGAGCTA CCAACTCTTT TTCCGAAGGT AACTGGCTTC AGCAGAGCGC
4621 AGATACCAAA TACTGTCCTT CTAGTGTAGC CGTAGTTAGG CCACCACTTC AAGAACTCTG
4681 TAGCACCGCC TACATACCTC GCTCTGCTAA TCCTGTTACC AGTGGCTGCT GCCAGTGGCG
4741 ATAAGTCGTG TCTTACCGGG TTGGACTCAA GACGATAGTT ACCGGATAAG GCGCAGCGGT
4801 CGGGCTGAAC GGGGGGTTCG TGCACACAGC CCAGCTTGGA GCGAACGACC TACACCGAAC
4861 TGAGATACCT ACAGCGTGAG CATTGAGAAA GCGCCACGCT TCCCGAAGGG AGAAAGGCGG
4921 ACAGGTATCC GGTAAGCGGC AGGGTCGGAA CAGGAGAGCG CACGAGGGAG CTTCCAGGGG
4981 GAAACGCCTG GTATCTTTAT AGTCCTGTCG GGTTTCGCCA CCTCTGACTT GAGCGTCGAT
5041 TTTTGTGATG CTCGTCAGGG GGGCGGAGCC TATGGAAAAA CGCCAGCAAC GCGGCCTTTT
5101 TACGGTTCCT GGCCTTTTGC TGGCCTTTTG CTCACATGTT CTTTCCTGCG TTATCCCCTG
5161 ATTCTGTGGA TAACCGTATT ACCGCCTTTG AGTGAGCTGA TACCGCTCGC CGCAGCCGAA
5221 CGACCGAGCG CAGCGAGTCA GTGAGCGAGG AAGCGGAAGA GCGCCTGATG CGGTATTTTC
5281 TCCTTACGCA TCTGTGCGGT ATTTCACACC GCAGACCAGC CGCGTAACCT GGCAAAATCG
5341 GTTACGGTTG AGTAATAAAT GGATGCCCTG CGTAAGCGGG TGTGGGCGGA CAATAAAGTC
5401 TTAAACTGAA CAAAATAGAT CTAAACTATG ACAATAAAGT CTTAAACTAG ACAGAATAGT
5461 TGTAAACTGA AATCAGTCCA GTTATGCTGT GAAAAAGCAT ACTGGACTTT TGTTATGGCT
5521 AAAGCAAACT CTTCATTTTC TGAAGTGCAA ATTGCCCGTC GTATTAAAGA GGGGCGTGGC
5581 CAAGGGCATG GTAAAGACTA TATTCGCGGC GTTGTGACAA TTTACCGAAC AACTCCGCGG
5641 CCGGGAAGCC GATCTCGGCT TGAACGAATT GTTAGGTGGC GGTACTTGGG TCGATATCAA
5701 AGTGCATCAC TTCTTCCCGT ATGCCCAACT TTGTATAGAG AGCCACTGCG GATCGTCAC
5761 CGTAATCTGC TTGCACGTAG ATCACATAAG CACCAAGCGC GTTGGCCTCA TGCTTGAGGA
5821 GATTGATGAG CGCGGTGGCA ATGCCCTGCC TCCGGTGCTC GCCGGAGACT GCGAGATCAT
5881 AGATATAGAT CTCACTACGC GGCTGCTCAA ACCTGGGCAG AACGTAAGCC GCGAGAGCGC
5941 CAACAACCGC TTCTTGGTCG AAGGCAGCAA GCGCGATGAA TGTCTTACTA CGGAGCAAGT
6001 TCCCGAGGTA ATCGGAGTCC GGCTGATGTT GGGAGTAGGT GGCTACGTCT CCGAACTCAC
6061 GACCGAAAAG ATCAAGAGCA GCCCGCATGG ATTTGACTTG GTCAGGGCCG AGCCTACATG
6121 TGCGAATGAT GCCCATACTT GAGCCACCTA ACTTTGTTTT AGGGCGACTG CCCTGCTGCG
6181 TAACATCGTT GCTGCTGCGT AACATCGTTG CTGCTCCATA ACATCAAACA TCGACCCACG
6241 GCGTAACGCG CTTGCTGCTT GGATGCCCGA GGCATAGACT GTACAAAAAA ACAGTCATAA
6301 CAAGCCATGA AAACCGCCAC TGCGCCGTTA CCACCGCTGC GTTCGGTCAA GGTTCTGGAC
6361 CAGTTGCGTG AGCGCATACG CTACTTGCAT TACAGTTTAC GAACCGAACA GGCTTATGTC
6421 AACTGGGTTC GTGCCTTCAT CCGTTTCCAC GGTGTGCGTC ACCCGGCAAC CTTGGGCAGC
6481 AGCGAAGTCG AGGCATTTCT GTCCTGGCTG GCGAACGAGC GCAAGGTTTC GGTCTCCACG
6541 CATCGTCAGG CATTGGCGGC CTTGCTGTTC TTCTACGGCA AGGTGCTGTG CACGGATCTG
6601 CCCTGGCTTC AGGAGATCGG AAGACCTCGG CCGTCGCGGC GCTTGCCGGT GGTGCTGACC
6661 CCGGATGA
```

FIG.39D

GLUTATHIONE-S-TRANSFERASE FUSION WITH POLYHEDRON PROMOTER FOR BACULOVIRUS EXPRESSION polh PROMOTER 430 ggc tac gta tac tcc gga ata tta ata gat cat gga gat aat taa aat gat
    ccg atg cat atg agg cct tat aat tat cta gta cct cta tta att tta cta → mRNA 481 aac cat ctc gca aat aaa taa gta ttt tac tgt ttt cgt aac agt ttt gta
    ttg gta gag cgt tta ttt att cat aaa atg aca aaa gca ttg tca aaa cat 532 ata aaa aaa cct ata aat att ccg gat tat tca tac cgt ccc acc atc ggg
    tat ttt ttt gga tat tta taa ggc cta ata agt atg gca ggg tgg tag ccc START TRANSLN.   M   A   P   I   -   -   -   GST   -   -
583 cgc gga tcc atg gcc cct ata cta ggt tat tgg aaa att aag ggc ctt gtg
    gcg cct agg tac cgg gga tat gat cca ata acc ttt taa ttc ccg gaa cac S   D   L   V   P   R   H   N   Q   T   S   L   Y   K   K   A
1246 tcg gat ctg gtt ccg cgt cat aat caa aca agt ttg tac aaa aaa gct gaa
     agc cta gac caa ggc gca gta tta gtt tgt tca aac atg ttt ttt cga ctt
                                                            Int 1297 cga gaa acg taa aat gat ata aat atc aat ata tta aat tag at
     gct ctt tgc att tta cta tat tta tag tta tat aat tta atc ta

FIG.40A pDEST20 7066 bp (rotated to position 5800)

| Location (Base Nos.) | Gene Encoded |
|---|---|
| 592..1263 | GST |
| 1397..1273 | attR1 |
| 1506..2165 | CmR |
| 2285..2369 | inactivated ccdA |
| 2507..2812 | ccdB |
| 2853..2977 | attR2 |
| 4214..5064 | ampR |
| 5263..5843 | ori |

```
   1 CCACTGCGCC GTTACCACCG CTGCGTTCGG TCAAGGTTCT GGACCAGTTG CGTGAGCGCA
  61 TACGCTACTT GCATTACAGT TTACGAACCG AACAGGCTTA TGTCAACTGG GTTCGTGCCT
 121 TCATCCGTTT CCACGGTGTG CGTCACCCGG CAACCTTGGG CAGCAGCGAA GTCGAGGCAT
 181 TTCTGTCCTG GCTGGCGAAC GAGCGCAAGG TTTCGGTCTC CACGCATCGT CAGGCATTGG
 241 CGGCCTTGCT GTTCTTCTAC GGCAAGGTGC TGTGCACGGA TCTGCCCTGG CTTCAGGAGA
 301 TCGGAAGACC TCGGCCGTCG CGGCGCTTGC CGGTGGTGCT GACCCCGGAT GAAGTGGTTC
 361 GCATCCTCGG TTTTCTGGAA GGCGAGCATC GTTTGTTCGC CCAGGACTCT AGCTATAGTT
 421 CTAGTGGTTG GCTACGTATA CTCCGGAATA TTAATAGATC ATGGAGATAA TTAAAATGAT
 481 AACCATCTCG CAAATAAATA AGTATTTTAC TGTTTTCGTA ACAGTTTTGT AATAAAAAAA
 541 CCTATAAATA TTCCGGATTA TTCATACCGT CCCACCATCG GGCGCGGATC CATGGCCCCT
 601 ATACTAGGTT ATTGGAAAAT TAAGGGCCTT GTGCAACCCA CTCGACTTCT TTTGGAATAT
 661 CTTGAAGAAA AATATGAAGA GCATTTGTAT GAGCGCGATG AAGGTGATAA ATGGCGAAAC
 721 AAAAAGTTTG AATTGGGTTT GGAGTTTCCC AATCTTCCTT ATTATATTGA TGGTGATGTT
 781 AAATTAACAC AGTCTATGGC CATCATACGT TATATAGCTG ACAAGCACAA CATGTTGGGT
 841 GGTTGTCCAA AAGAGCGTGC AGAGATTTCA ATGCTTGAAG GAGCGGTTTT GGATATTAGA
 901 TACGGTGTTT CGAGAATTGC ATATAGTAAA GACTTTGAAA CTCTCAAAGT TGATTTTCTT
 961 AGCAAGCTAC CTGAAATGCT GAAAATGTTC GAAGATCGTT TATGTCATAA AACATATTTA
1021 AATGGTGATC ATGTAACCCA TCCTGACTTC ATGTTGTATG ACGCTCTTGA TGTTGTTTTA
1081 TACATGGACC CAATGTGCCT GGATGCGTTC CCAAAATTAG TTTGTTTTAA AAAACGTATT
1141 GAAGCTATCC CACAAATTGA TAAGTACTTG AAATCCAGCA AGTATATAGC ATGGCCTTTG
1201 CAGGGCTGGC AAGCCACGTT TGGTGGTGGC GACCATCCTC CAAAATCGGA TCTGGTTCCG
1261 CGTCATAATC AAACAAGTTT GTACAAAAAA GCTGAACGAG AAACGTAAAA TGATATAAAT
1321 ATCAATATAT TAAATTAGAT TTTGCATAAA AAACAGACTA CATAATACTG TAAAACACAA
1381 CATATCCAGT CACTATGGCG GCCGCATTAG CACCCCAGG CTTTACACTT TATGCTTCCG
1441 GCTCGTATGT TGTGTGGATT TGAGTTAGG ATCCGGCGAG ATTTTCAGGA GCTAAGGAAG
1501 CTAAAATGGA GAAAAAAATC ACTGGATATA CCACCGTTGA TATATCCCAA TGGCATCGTA
1561 AAGAACATTT TGAGGCATTT CAGTCAGTTG CTCAATGTAC CTATAACCAG ACCGTTCAGC
1621 TGGATATTAC GGCCTTTTTA AAGACCGTAA AGAAAAATAA GCACAAGTTT TATCCGGCCT
1681 TTATTCACAT TCTTGCCCGC CTGATGAATG CTCATCCGGA ATTCCGTATG GCAATGAAAG
1741 ACGGTGAGCT GGTGATATGG GATAGTGTTC ACCCTTGTTA CACCGTTTTC CATGAGCAAA
1801 CTGAAACGTT TTCATCGCTC TGGAGTGAAT ACCACGACGA TTTCCGGCAG TTTCTACACA
1861 TATATTCGCA AGATGTGGCG TGTTACGGTG AAAACCTGGC CTATTTCCCT AAAGGGTTTA
1921 TTGAGAATAT GTTTTTCGTC TCAGCCAATC CCTGGGTGAG TTTCACCAGT TTTGATTTAA
```

FIG.40B

```
1981 ACGTGGCCAA TATGGACAAC TTCTTCGCCC CCGTTTTCAC CATGGGCAAA TATTATACGC
2041 AAGGCGACAA GGTGCTGATG CCGCTGGCGA TTCAGGTTCA TCATGCCGTC TGTGATGGCT
2101 TCCATGTCGG CAGAATGCTT AATGAATTAC AACAGTACTG CGATGAGTGG CAGGGCGGGG
2161 CGTAATCTAG AGGATCCGGC TTACTAAAAG CCAGATAACA GTATGCGTAT TTGCGCGCTG
2221 ATTTTTTGCGG TATAAGAATA TATACTGATA TGTATACCCG AAGTATGTCA AAAAGAGGTG
2281 TGCTATGAAG CAGCGTATTA CAGTGACAGT TGACAGCGAC AGCTATCAGT TGCTCAAGGC
2341 ATATATGATG TCAATATCTC CGGTCTGGTA AGCACAACCA TGCAGAATGA AGCCCGTCGT
2401 CTGCGTGCCG AACGCTGGAA AGCGGAAAAT CAGGAAGGGA TGGCTGAGGT CGCCCGGTTT
2461 ATTGAAATGA ACGGCTCTTT TGCTGACGAG AACAGGGACT GGTGAAATGC AGTTTAAGGT
2521 TTACACCTAT AAAAGAGAGA GCCGTTATCG TCTGTTTGTG GATGTACAGA GTGATATTAT
2581 TGACACGCCC GGGCGACGGA TGGTGATCCC CCTGGCCAGT GCACGTCTGC TGTCAGATAA
2641 AGTCTCCCGT GAACTTTACC CGGTGGTGCA TATCGGGGAT GAAAGCTGGC GCATGATGAC
2701 CACCGATATG GCCAGTGTGC CGGTCTCCGT TATCGGGGAA GAAGTGGCTG ATCTCAGCCA
2761 CCGCGAAAAT GACATCAAAA ACGCCATTAA CCTGATGTTC TGGGGAATAT AAATGTCAGG
2821 CTCCCTTATA CACAGCCAGT CTGCAGGTCG ACCATAGTGA CTGGATATGT TGTGTTTTAC
2881 AGTATTATGT AGTCTGTTTT TTATGCAAAA TCTAATTTAA TATATTGATA TTTATATCAT
2941 TTTACGTTTC TCGTTCAGCT TTCTTGTACA AAGTGGTTTG ATAGCTTGTC GAGAAGTACT
3001 AGAGGATCAT AATCAGCCAT ACCACATTTG TAGAGGTTTT ACTTGCTTTA AAAAACCTCC
3061 CACACCTCCC CCTGAACCTG AAACATAAAA TGAATGCAAT TGTTGTTGTT AACTTGTTTA
3121 TTGCAGCTTA TAATGGTTAC AAATAAAGCA ATAGCATCAC AAATTTCACA AATAAAGCAT
3181 TTTTTTCACT GCATTCTAGT TGTGGTTTGT CCAAACTCAT CAATGTATCT TATCATGTCT
3241 GGATCTGATC ACTGCTTGAG CCTAGGAGAT CCGAACCAGA TAAGTGAAAT CTAGTTCCAA
3301 ACTATTTTGT CATTTTTAAT TTTCGTATTA GCTTACGACG CTACACCCAG TTCCCATCTA
3361 TTTTGTCACT CTTCCCTAAA TAATCCTTAA AAACTCCATT TCCACCCCTC CCAGTTCCCA
3421 ACTATTTTGT CCGCCCACAG CGGGGCATTT TCTTCCTGT TATGTTTTTA ATCAAACATC
3481 CTGCCAACTC CATGTGACAA ACCGTCATCT TCGGCTACTT TTTCTCTGTC ACAGAATGAA
3541 AATTTTTCTG TCATCTCTTC GTTATTAATG TTTGTAATTG ACTGAATATC AACGCTTATT
3601 TGCAGCCTGA ATGGCGAATG GACGCGCCCT GTAGCGGCGC ATTAAGCGCG GCGGGTGTGG
3661 TGGTTACGCG CAGCGTGACC GCTACACTTG CCAGCGCCCT AGCGCCCGCT CCTTTCGCTT
3721 TCTTCCCTTC CTTTCTCGCC ACGTTCGCCG GCTTTCCCCG TCAAGCTCTA AATCGGGGGC
3781 TCCCTTTAGG GTTCCGATTT AGTGCTTTAC GGCACCTCGA CCCCAAAAAA CTTGATTAGG
3841 GTGATGGTTC ACGTAGTGGG CCATCGCCCT GATAGACGGT TTTTCGCCCT TTGACGTTGG
3901 AGTCCACGTT CTTTAATAGT GGACTCTTGT TCCAAACTGG AACAACACTC AACCCTATCT
3961 CGGTCTATTC TTTTGATTTA TAAGGGATTT TGCCGATTTC GGCCTATTGG TTAAAAAATG
4021 AGCTGATTTA ACAAAAATTT AACGCGAATT TTAACAAAAT ATTAACGTTT ACAATTTCAG
4081 GTGGCACTTT TCGGGGAAAT GTGCGCGGAA CCCCTATTTG TTTATTTTTC TAAATACATT
4141 CAAATATGTA TCCGCTCATG AGACAATAAC CCTGATAAAT GCTTCAATAA TATTGAAAAA
4201 GGAAGAGTAT GAGTATTCAA CATTTCCGTG TCGCCCTTAT TCCCTTTTTT GCGGCATTTT
4261 GCCTTCCTGT TTTTGCTCAC CCAGAAACGC TGGTGAAAGT AAAAGATGCT GAAGATCAGT
4321 TGGGTGCACG AGTGGGTTAC ATCGAACTGG ATCTCAACAG CGGTAAGATC CTTGAGAGTT
4381 TTCGCCCCGA AGAACGTTTT CCAATGATGA GCACTTTTAA AGTTCTGCTA TGTGGCGCGG
4441 TATTATCCCG TATTGACGCC GGGCAAGAGC AACTCGGTCG CCGCATACAC TATTCTCAGA
4501 ATGACTTGGT TGAGTACTCA CCAGTCACAG AAAAGCATCT TACGGATGGC ATGACAGTAA
```

FIG.40C

```
4561 GAGAATTATG CAGTGCTGCC ATAACCATGA GTGATAACAC TGCGGCCAAC TTACTTCTGA
4621 CAACGATCGG AGGACCGAAG GAGCTAACCG CTTTTTTGCA CAACATGGGG GATCATGTAA
4681 CTCGCCTTGA TCGTTGGGAA CCGGAGCTGA ATGAAGCCAT ACCAAACGAC GAGCGTGACA
4741 CCACGATGCC TGTAGCAATG GCAACAACGT TGCGCAAACT ATTAACTGGC GAACTACTTA
4801 CTCTAGCTTC CCGGCAACAA TTAATAGACT GGATGGAGGC GGATAAAGTT GCAGGACCAC
4861 TTCTGCGCTC GGCCCTTCCG GCTGGCTGGT TTATTGCTGA TAAATCTGGA GCCGGTGAGC
4921 GTGGGTCTCG CGGTATCATT GCAGCACTGG GGCCAGATGG TAAGCCCTCC CGTATCGTAG
4981 TTATCTACAC GACGGGGAGT CAGGCAACTA TGGATGAACG AAATAGACAG ATCGCTGAGA
5041 TAGGTGCCTC ACTGATTAAG CATTGGTAAC TGTCAGACCA AGTTTACTCA TATATACTTT
5101 AGATTGATTT AAAACTTCAT TTTTAATTTA AAAGGATCTA GGTGAAGATC CTTTTTGATA
5161 ATCTCATGAC CAAAATCCCT TAACGTGAGT TTTCGTTCCA CTGAGCGTCA GACCCCGTAG
5221 AAAAGATCAA AGGATCTTCT TGAGATCCTT TTTTTCTGCG CGTAATCTGC TGCTTGCAAA
5281 CAAAAAAACC ACCGCTACCA GCGGTGGTTT GTTTGCCGGA TCAAGAGCTA CCAACTCTTT
5341 TTCCGAAGGT AACTGGCTTC AGCAGAGCGC AGATACCAAA TACTGTCCTT CTAGTGTAGC
5401 CGTAGTTAGG CCACCACTTC AAGAACTCTG TAGCACCGCC TACATACCTC GCTCTGCTAA
5461 TCCTGTTACC AGTGGCTGCT GCCAGTGGCG ATAAGTCGTG TCTTACCGGG TTGGACTCAA
5521 GACGATAGTT ACCGGATAAG GCGCAGCGGT CGGGCTGAAC GGGGGGTTCG TGCACACAGC
5581 CCAGCTTGGA GCGAACGACC TACACCGAAC TGAGATACCT ACAGCGTGAG CATTGAGAAA
5641 GCGCCACGCT TCCCGAAGGG AGAAAGGCGG ACAGGTATCC GGTAAGCGGC AGGGTCGGAA
5701 CAGGAGAGCG CACGAGGGAG CTTCCAGGGG GAAACGCCTG GTATCTTTAT AGTCCTGTCG
5761 GGTTTCGCCA CCTCTGACTT GAGCGTCGAT TTTTGTGATG CTCGTCAGGG GGGCGGAGCC
5821 TATGGAAAAA CGCCAGCAAC GCGGCCTTTT TACGGTTCCT GGCCTTTTGC TGGCCTTTTG
5881 CTCACATGTT CTTTCCTGCG TTATCCCCTG ATTCTGTGGA TAACCGTATT ACCGCCTTTG
5941 AGTGAGCTGA TACCGCTCGC CGCAGCCGAA CGACCGAGCG CAGCGAGTCA GTGAGCGAGG
6001 AAGCGGAAGA GCGCCTGATG CGGTATTTTC TCCTTACGCA TCTGTGCGGT ATTTCACACC
6061 GCAGACCAGC CGCGTAACCT GGCAAAATCG GTTACGGTTG AGTAATAAAT GGATGCCCTG
6121 CGTAAGCGGG TGTGGGCGGA CAATAAAGTC TTAAACTGAA CAAAATAGAT CTAAACTATG
6181 ACAATAAAGT CTTAAACTAG ACAGAATAGT TGTAAACTGA AATCAGTCCA GTTATGCTGT
6241 GAAAAAGCAT ACTGGACTTT TGTTATGGCT AAAGCAAACT CTTCATTTTC TGAAGTGCAA
6301 ATTGCCCGTC GTATTAAAGA GGGGCGTGGC CAAGGGCATG GTAAAGACTA TATTCGCGGC
6361 GTTGTGACAA TTTACCGAAC AACTCCGCGG CCGGGAAGCC GATCTCGGCT TGAACGAATT
6421 GTTAGGTGGC GGTACTTGGG TCGATATCAA AGTGCATCAC TTCTTCCCGT ATGCCCAACT
6481 TTGTATAGAG AGCCACTGCG GATCGTCAC CGTAATCTGC TTGCACGTAG ATCACATAAG
6541 CACCAAGCGC GTTGGCCTCA TGCTTGAGGA GATTGATGAG CGCGGTGGCA ATGCCCTGCC
6601 TCCGGTGCTC GCCGGAGACT GCGAGATCAT AGATATAGAT CTCACTACGC GGCTGCTCAA
6661 ACCTGGGCAG AACGTAAGCC GCGAGAGCGC CAACAACCGC TTCTTGGTCG AAGGCAGCAA
6721 GCGCGATGAA TGTCTTACTA CGGAGCAAGT TCCCGAGGTA ATCGGAGTCC GGCTGATGTT
6781 GGGAGTAGGT GGCTACGTCT CCGAACTCAC GACCGAAAAG ATCAAGAGCA GCCCGCATGG
6841 ATTTGACTTG GTCAGGGCCA GCCTACATG TGCGAATGAT GCCCATACTT GAGCCACCTA
6901 ACTTTGTTTT AGGGCGACTG CCCTGCTGCG TAACATCGTT GCTGCTGCGT AACATCGTTG
6961 CTGCTCCATA ACATCAAACA TCGACCCACG GCGTAACGCG CTTGCTGCTT GGATGCCCGA
7021 GGCATAGACT GTACAAAAAA ACAGTCATAA CAAGCCATGA AAACCG
```

FIG.4OD pDEST21 11713 bp (rotated to position 11000)

| Location (Base Nos.) | Gene Encoded |
|---|---|
| 857..1322 | GAL4DB |
| 1456..1332 | attR1 |
| 1706..2365 | CmR |
| 2485..2569 | inactivated ccdA |
| 2707..3012 | ccdB |
| 3053..3177 | attR2 |
| 3716..3735 | pT7 (T7 promoter) |
| 3899..4354 | f1 (f1 intergenic region) |
| 4414..6642 | Leu2 |
| 7541..8515 | kanR |
| 9668..10958 | CYH2 |
| 11118..848 | pADH (ADH promoter) |

```
   1 TTTATTATGT TACAATATGG AAGGGAACTT TACACTTCTC CTATGCACAT ATATTAATTA
  61 AAGTCCAATG CTAGTAGAGA AGGGGGGTAA CACCCCTCCG CGCTCTTTTC CGATTTTTTT
 121 CTAAACCGTG AATATTTCG GATATCCTTT TGTTGTTTCC GGGTGTACAA TATGGACTTC
 181 CTCTTTTCTG GCAACCAAAC CCATACATCG GGATTCCTAT AATACCTTCG TTGGTCTCCC
 241 TAACATGTAG GTGGCGGAGG GGAGATATAC AATAGAACAG ATACCAGACA AGACATAATG
 301 GGCTAAACAA GACTACACCA ATTACACTGC CTCATTGATG GTGGTACATA ACGAACTAAT
 361 ACTGTAGCCC TAGACTTGAT AGCCATCATC ATATCGAAGT TTCACTACCC TTTTTTCCATT
 421 TGCCATCTAT TGAAGTAATA ATAGGCGCAT GCAACTTCTT TTCTTTTTTT TTCTTTTCTC
 481 TCTCCCCCGT TGTTGTCTCA CCATATCCGC AATGACAAAA AAAATGATGG AAGACACTAA
 541 AGGAAAAAAT TAACGACAAA GACAGCACCA ACAGATGTCG TTGTTCCAGA GCTGATGAGG
 601 GGTATCTTCG AACACACGAA ACTTTTTTCCT TCCTTCATTC ACGCACACTA CTCTCTAATG
 661 AGCAACGGTA TACGGCCTTC CTTCCAGTTA CTTGAATTTG AAATAAAAAA AGTTTGCCGC
 721 TTTGCTATCA AGTATAAATA GACCTGCAAT TATTAATCTT TTGTTTCCTC GTCATTGTTC
 781 TCGTTCCCTT TCTTCCTTGT TTCTTTTTCT GCACAATATT TCAAGCTATA CCAAGCATAC
 841 AATCAACTCC AAGCTTGAAG CAAGCCTCCT GAAAGATGAA GCTACTGTCT TCTATCGAAC
 901 AAGCATGCGA TATTTGCCGA CTTAAAAAGC TCAAGTGCTC CAAAGAAAAA CCGAAGTGCG
 961 CCAAGTGTCT GAAGAACAAC TGGGAGTGTC GCTACTCTCC CAAAACCAAA AGGTCTCCGC
1021 TGACTAGGGC ACATCTGACA GAAGTGGAAT CAAGGCTAGA AAGACTGGAA CAGCTATTTC
1081 TACTGATTTT TCCTCGAGAA GACCTTGACA TGATTTTGAA AATGGATTCT TTACAGGATA
1141 TAAAAGCATT GTTAACAGGA TTATTTGTAC AAGATAATGT GAATAAAGAT GCCGTCACAG
1201 ATAGATTGGC TTCAGTGGAG ACTGATATGC CTCTAACATT GAGACAGCAT AGAATAAGTG
1261 CGACATCATC ATCGGAAGAG AGTAGTAACA AAGGTCAAAG ACAGTTGACT GTATCGTCGA
1321 GGTCGAATCA AACAAGTTTG TACAAAAAAG CTGAACGAGA AACGTAAAAT GATATAAATA
1381 TCAATATATT AAATTAGATT TTGCATAAAA AACAGACTAC ATAATACTGT AAAACACAAC
1441 ATATCCAGTC ACTATGGCGG CCGCTAAGTT GGCAGCATCA CCCGACGCAC TTTGCGCCGA
1501 ATAAATACCT GTGACGGAAG ATCACTTCGC AGAATAAATA AATCCTGGTG TCCCTGTTGA
1561 TACCGGGAAG CCCTGGGCCA ACTTTTGGCG AAAATGAGAC GTTGATCGGC ACGTAAGAGG
1621 TTCCAACTTT CACCATAATG AAATAAGATC ACTACCGGGC GTATTTTTTG AGTTATCGAG
1681 ATTTTCAGGA GCTAAGGAAG CTAAAATGGA GAAAAAAATC ACTGGATATA CCACCGTTGA
```

FIG.41B

```
1741 TATATCCCAA TGGCATCGTA AAGAACATTT TGAGGCATTT CAGTCAGTTG CTCAATGTAC
1801 CTATAACCAG ACCGTTCAGC TGGATATTAC GGCCTTTTTA AAGACCGTAA AGAAAAATAA
1861 GCACAAGTTT TATCCGGCCT TTATTCACAT TCTTGCCCGC CTGATGAATG CTCATCCGGA
1921 ATTCCGTATG GCAATGAAAG ACGGTGAGCT GGTGATATGG GATAGTGTTC ACCCTTGTTA
1981 CACCGTTTTC CATGAGCAAA CTGAAACGTT TTCATCGCTC TGGAGTGAAT ACCACGACGA
2041 TTTCCGGCAG TTTCTACACA TATATTCGCA AGATGTGGCG TGTTACGGTG AAAACCTGGC
2101 CTATTTCCCT AAAGGGTTTA TTGAGAATAT GTTTTTCGTC TCAGCCAATC CCTGGGTGAG
2161 TTTCACCAGT TTTGATTTAA ACGTGGCCAA TATGGACAAC TTCTTCGCCC CCGTTTTCAC
2221 CATGGGCAAA TATTATACGC AAGGCGACAA GGTGCTGATG CCGCTGGCGA TTCAGGTTCA
2281 TCATGCCGTC TGTGATGGCT TCCATGTCGG CAGAATGCTT AATGAATTAC AACAGTACTG
2341 CGATGAGTGG CAGGGCGGGG CGTAATCTAG AGGATCCGGC TTACTAAAAG CCAGATAACA
2401 GTATGCGTAT TTGCGCGCTG ATTTTTGCGG TATAAGAATA TATACTGATA TGTATACCCG
2461 AAGTATGTCA AAAAGAGGTG TGCTATGAAG CAGCGTATTA CAGTGACAGT TGACAGCGAC
2521 AGCTATCAGT TGCTCAAGGC ATATATGATG TCAATATCTC CGGTCTGGTA AGCACAACCA
2581 TGCAGAATGA AGCCCGTCGT CTGCGTGCCG AACGCTGGAA AGCGGAAAAT CAGGAAGGGA
2641 TGGCTGAGGT CGCCCGGTTT ATTGAAATGA ACGGCTCTTT TGCTGACGAG AACAGGGACT
2701 GGTGAAATGC AGTTTAAGGT TTACACCTAT AAAAGAGAGA GCCGTTATCG TCTGTTTGTG
2761 GATGTACAGA GTGATATTAT TGACACGCCC GGGCGACGGA TGGTGATCCC CCTGGCCAGT
2821 GCACGTCTGC TGTCAGATAA AGTCTCCCGT GAACTTTACC CGGTGGTGCA TATCGGGGAT
2881 GAAAGCTGGC GCATGATGAC CACCGATATG GCCAGTGTGC CGGTCTCCGT TATCGGGGAA
2941 GAAGTGGCTG ATCTCAGCCA CCGCGAAAAT GACATCAAAA ACGCCATTAA CCTGATGTTC
3001 TGGGGAATAT AAATGTCAGG CTCCCTTATA CACAGCCAGT CTGCAGGTCG ACCATAGTGA
3061 CTGGATATGT TGTGTTTTAC AGTATTATGT AGTCTGTTTT TTATGCAAAA TCTAATTTAA
3121 TATATTGATA TTTATATCAT TTTACGTTTC TCGTTCAGCT TTCTTGTACA AAGTGGTTTG
3181 ATGGCCGCTA AGTAAGTAAG ACGTCGAGCT CTAAGTAAGT AACGGCCGCC ACCGCGGTGG
3241 AGCTTTGGAC TTCTTCGCCA GAGGTTTGGT CAAGTCTCCA ATCAAGGTTG TCGGCTTGTC
3301 TACCTTGCCA GAAATTTACG AAAAGATGGA AAAGGGTCAA ATCGTTGGTA GATACGTTGT
3361 TGACACTTCT AAATAAGCGA ATTTCTTATG ATTTATGATT TTTATTATTA AATAAGTTAT
3421 AAAAAAAATA AGTGTATACA AATTTTAAAG TGACTCTTAG GTTTTAAAAC GAAAATTCTT
3481 ATTCTTGAGT AACTCTTTCC TGTAGGTCAG GTTGCTTTCT CAGGTATAGC ATGAGGTCGC
3541 TCTTATTGAC CACACCTCTA CCGGCATGCC GAGCAAATGC CTGCAAATCG CTCCCCATTT
3601 CACCCAATTG TAGATATGCT AACTCCAGCA ATGAGTTGAT GAATCTCGGT GTGTATTTTA
3661 TGTCCTCAGA GGACAATACC TGTTGTAATC GTTCTTCCAC ACGGATCCCA ATTCGCCCTA
3721 TAGTGAGTCG TATTACAATT CACTGGCCGT CGTTTTACAA CGTCGTGACT GGGAAAACCC
3781 TGGCGTTACC CAACTTAATC GCCTTGCAGC ACATCCCCCT TTCGCCAGCT GGCGTAATAG
3841 CGAAGAGGCC CGCACCGATC GCCCTTCCCA ACAGTTGCGC AGCCTGAATG GCGAATGGAC
3901 GCGCCCTGTA GCGGCGCATT AAGCGCGGCG GGTGTGGTGG TTACGCGCAG CGTGACCGCT
3961 ACACTTGCCA GCGCCCTAGC GCCCGCTCCT TTCGCTTTCT TCCCTTCCTT TCTCGCCACG
4021 TTCGCCGGCT TTCCCCGTCA AGCTCTAAAT CGGGGGCTCC CTTTAGGGTT CCGATTTAGT
4081 GCTTTACGGC ACCTCGACCC CAAAAAACTT GATTAGGGTG ATGGTTCACG TAGTGGGCCA
4141 TCGCCCTGAT AGACGGTTTT TCGCCCTTTG ACGTTGGAGT CCACGTTCTT TAATAGTGGA
4201 CTCTTGTTCC AAACTGGAAC AACACTCAAC CCTATCTCGG TCTATTCTTT TGATTTATAA
4261 GGGATTTTGC CGATTTCGGC CTATTGGTTA AAAAATGAGC TGATTTAACA AAAATTTAAC
```

FIG.41C

```
4321 GCGAATTTTA ACAAAATATT AACGTTTACA ATTTCCTGAT GCGGTATTTT CTCCTTACGC
4381 ATCTGTGCGG TATTTCACAC CGCATATCGA CCGGTCGAGG AGAACTTCTA GTATATCCAC
4441 ATACCTAATA TTATTGCCTT ATTAAAAATG GAATCGGAAC AATTACATCA AAATCCACAT
4501 TCTCTTCAAA ATCAATTGTC CTGTACTTCC TTGTTCATGT GTGTTCAAAA ACGTTATATT
4561 TATAGGATAA TTATACTCTA TTTCTCAACA AGTAATTGGT TGTTTGGCCG AGCGGTCTAA
4621 GGCGCCTGAT TCAAGAAATA TCTTGACCGC AGTTAACTGT GGGAATACTC AGGTATCGTA
4681 AGATGCAAGA GTTCGAATCT CTTAGCAACC ATTATTTTTT TCCTCAACAT AACGAGAACA
4741 CACAGGGGCG CTATCGCACA GAATCAAATT CGATGACTGG AAATTTTTTG TTAATTTCAG
4801 AGGTCGCCTG ACGCATATAC CTTTTTCAAC TGAAAAATTG GGAGAAAAAG GAAAGGTGAG
4861 AGGCCGGAAC CGGCTTTTCA TATAGAATAG AGAAGCGTTC ATGACTAAAT GCTTGCATCA
4921 CAATACTTGA AGTTGACAAT ATTATTTAAG GACCTATTGT TTTTTCCAAT AGGTGGTTAG
4981 CAATCGTCTT ACTTTCTAAC TTTTCTTACC TTTTACATTT CAGCAATATA TATATATATT
5041 TCAAGGATAT ACCATTCTAA TGTCTGCCCC TATGTCTGCC CCTAAGAAGA TCGTCGTTTT
5101 GCCAGGTGAC CACGTTGGTC AAGAAATCAC AGCCGAAGCC ATTAAGGTTC TTAAAGCTAT
5161 TTCTGATGTT CGTTCCAATG TCAAGTTCGA TTTCGAAAAT CATTTAATTG GTGGTGCTGC
5221 TATCGATGCT ACAGGTGTCC CACTTCCAGA TGAGGCGCTG GAAGCCTCCA AGAAGGTTGA
5281 TGCCGTTTTG TTAGGTGCTG TGGGTGGTCC TAAATGGGGT ACCGGTAGTG TTAGACCTGA
5341 ACAAGGTTTA CTAAAAATCC GTAAAGAACT TCAATTGTAC GCCAACTTAA GACCATGTAA
5401 CTTTGCATCC GACTCTCTTT TAGACTTATC TCCAATCAAG CCACAATTTG CTAAAGGTAC
5461 TGACTTCGTT GTTGTCAGAG AATTAGTGGG AGGTATTTAC TTTGGTAAGA GAAAGGAAGA
5521 CGATGGTGAT GGTGTCGCTT GGGATAGTGA ACAATACACC GTTCCAGAAG TGCAAAGAAT
5581 CACAAGAATG GCCGCTTTCA TGGCCCTACA ACATGAGCCA CCATTGCCTA TTTGGTCCTT
5641 GGATAAAGCT AATGTTTTGG CCTCTTCAAG ATTATGGAGA AAAACTGTGG AGGAAACCAT
5701 CAAGAACGAA TTCCCTACAT TGAAGGTTCA ACATCAATTG ATTGATTCTG CCGCCATGAT
5761 CCTAGTTAAG AACCCAACCC ACCTAAATGG TATTATAATC ACCAGCAACA TGTTTGGTGA
5821 TATCATCTCC GATGAAGCCT CCGTTATCCC AGGTTCCTTG GGTTTGTTGC CATCTGCGTC
5881 CTTGGCCTCT TTGCCAGACA AGAACACCGC ATTTGGTTTG TACGAACCAT GCCACGGTTC
5941 TGCTCCAGAT TTGCCAAAGA ATAAGGTTGA CCCTATCGCC ACTATCTTGT CTGCTGCAAT
6001 GATGTTGAAA TTGTCATTGA ACTTGCCTGA AGAAGGTAAG GCCATTGAAG ATGCAGTTAA
6061 AAAGGTTTTG GATGCAGGTA TCAGAACTGG TGATTTAGGT GGTTCCAACA GTACCACCGA
6121 AGTCGGTGAT GCTGTCGCCG AAGAAGTTAA GAAAATCCTT GCTTAAAAAG ATTCTCTTTT
6181 TTTATGATAT TTGTACATAA ACTTTATAAA TGAAATTCAT AATAGAAACG ACACGAAATT
6241 ACAAAATGGA ATATGTTCAT AGGGTAGACG AAACTATATA CGCAATCTAC ATACATTTAT
6301 CAAGAAGGAG AAAAAGGAGG ATAGTAAAGG AATACAGGTA AGCAAATTGA TACTAATGGC
6361 TCAACGTGAT AAGGAAAAAG AATTGCACTT TAACATTAAT ATTGACAAGG AGGAGGGCAC
6421 CACACAAAAA GTTAGGTGTA ACAGAAAATC ATGAAACTAC GATTCCTAAT TTGATATTGG
6481 AGGATTTTCT CTAAAAAAAA AAAAATACAA CAAATAAAAA ACACTCAATG ACCTGACCAT
6541 TTGATGGAGT TTAAGTCAAT ACCTTCTTGA ACCATTTCCC ATAATGGTGA AAGTTCCCTC
6601 AAGAATTTTA CTCTGTCAGA AACGGCCTTA CGACGTAGTC GATATGGTGC ACTCTCAGTA
6661 CAATCTGCTC TGATGCCGCA TAGTTAAGCC AGCCCCGACA CCCGCCAACA CCCGCTGACG
6721 CGCCCTGACG GGCTTGTCTG CTCCCGGCAT CCGCTTACAG ACAAGCTGTG ACCGTCTCCG
6781 GGAGCTGCAT GTGTCAGAGG TTTTCACCGT CATCACCGAA ACGCGCGAGA CGAAAGGGCC
6841 TCGTGATACG CCTATTTTTA TAGGTTAATG TCATGATAAT AATGGTTTCT TAGGACGGAT
```

FIG.41D

```
6901 CGCTTGCCTG TAACTTACAC GCGCCTCGTA TCTTTTAATG ATGGAATAAT TTGGGAATTT
6961 ACTCTGTGTT TATTTATTTT TATGTTTTGT ATTTGGATTT TAGAAAGTAA ATAAAGAAGG
7021 TAGAAGAGTT ACGGAATGAA GAAAAAAAAA TAAACAAAGG TTTAAAAAAT TTCAACAAAA
7081 AGCGTACTTT ACATATATAT TTATTAGACA AGAAAAGCAG ATTAAATAGA TATACATTCG
7141 ATTAACGATA AGTAAAATGT AAAATCACAG GATTTTCGTG TGTGGTCTTC TACACAGACA
7201 AGATGAAACA ATTCGGCATT AATACCTGAG AGCAGGAAGA GCAAGATAAA AGGTAGTATT
7261 TGTTGGCGAT CCCCCTAGAG TCTTTTACAT CTTCGGAAAA CAAAAACTAT TTTTTCTTTA
7321 ATTTCTTTTT TTACTTTCTA TTTTTAATTT ATATATTTAT ATTAAAAAAT TTAAATTATA
7381 ATTATTTTTA TAGCACGTGA TGAAAAGGAC CCAGGTGGCA CTTTTCGGGG AAATGTGCGC
7441 GGAACCCCTA TTTGTTTATT TTTCTAAATA CATTCAAATA TGTATCCGCT CATGAGACAA
7501 TAACCCTGAT AAATGCTTCA ATAATCTGCA GCTCTGGCCC GTGTCTCAAA ATCTCTGATG
7561 TTACATTGCA CAAGATAAAA ATATATCATC ATGAACAATA AAACTGTCTG CTTACATAAA
7621 CAGTAATACA AGGGGTGTTA TGAGCCATAT TCAACGGGAA ACGTCTTGCT GGAGGCCGCG
7681 ATTAAATTCC AACATGGATG CTGATTTATA TGGGTATAAA TGGGCTCGCG ATAATGTCGG
7741 GCAATCAGGT GCGACAATCT TTCGATTGTA TGGGAAGCCC GATGCGCCAG AGTTGTTTCT
7801 GAAACATGGC AAAGGTAGCG TTGCCAATGA TGTTACAGAT GAGATGGTCA GACTAAACTG
7861 GCTGACGAAA TTTATGCCTC TTCCGACCAT CAAGCATTTT ATCCGTACTC CTGATGATGC
7921 ATGGTTACTC ACCACTGCGA TCCGCGGGAA AACAGCATTC CAGGTATTAG AAGAATATCC
7981 TGATTCAGGT GAAAATATTG TTGATGCGCT GGCAGTGTTC CTGCGCCGGT TGCATTCGAT
8041 TCCTGTTTGT AATTGTCCTT TTAACAGCGA TCGCGTATTT CGTCTCGCTC AGGCGCAATC
8101 ACGAATGAAT AACGGTTTGG TTGATGCGAG TGATTTTGAT GACGAGCGTA ATGGCTGGCC
8161 TGTTGAACAA GTCTGGAAAG AAATGCATAC GCTTTTGCCA TTCTCACCGG ATTCAGTCGT
8221 CACTCATGGT GATTTCTCAC TTGATAACCT TATTTTTGAC GAGGGGAAAT TAATAGGTTG
8281 TATTGATGTT GGACGAGTCG GAATCGCAGA CCGATACCAG GATCTTGCCA TCCTATGGAA
8341 CTGCCTCGGT GAGTTTTCTC CTTCATTACA GAAACGGCTT TTTCAAAAAT ATGGTATTGA
8401 TAATCCTGAT ATGAATAAAT TGCAGTTTCA TTTGATGCTC GATGAGTTTT TCTAATCAGA
8461 ATTGGTTAAT TGGTTGTAAC ACTGGCAGAG CATTACGCTG ACTTGACGGG ACGGCGCATG
8521 ACCAAAATCC CTTAACGTGA GTTTTCGTTC CACTGAGCGT CAGACCCCGT AGAAAAGATC
8581 AAAGGATCTT CTTGAGATCC TTTTTTTCTG CGCGTAATCT GCTGCTTGCA AACAAAAAAA
8641 CCACCGCTAC CAGCGGTGGT TTGTTTGCCG GATCAAGAGC TACCAACTCT TTTTCCGAAG
8701 GTAACTGGCT TCAGCAGAGC GCAGATACCA AATACTGTCC TTCTAGTGTA GCCGTAGTTA
8761 GGCCACCACT TCAAGAACTC TGTAGCACCG CCTACATACC TCGCTCTGCT AATCCTGTTA
8821 CCAGTGGCTG CTGCCAGTGG CGATAAGTCG TGTCTTACCG GGTTGGACTC AAGACGATAG
8881 TTACCGGATA AGGCGCAGCG GTCGGGCTGA ACGGGGGGTT CGTGCACACA GCCCAGCTTG
8941 GAGCGAACGA CCTACACCGA ACTGAGATAC CTACAGCGTG AGCATTGAGA AAGCGCCACG
9001 CTTCCCGAAG GGAGAAAGGC GGACAGGTAT CCGGTAAGCG GCAGGGTCGG AACAGGAGAG
9061 CGCACGAGGG AGCTTCCAGG GGGGAACGCC TGGTATCTTT ATAGTCCTGT CGGGTTTCGC
9121 CACCTCTGAC TTGAGCGTCG ATTTTTGTGA TGCTCGTCAG GGGGGCCGAG CCTATGGAAA
9181 AACGCCAGCA ACGCGGCCTT TTTACGGTTC CTGGCCTTTT GCTGGCCTTT TGCTCACATG
9241 TTCTTTCCTG CGTTATCCCC TGATTCTGTG GATAACCGTA TTACCGCCTT TGAGTGAGCT
9301 GATACCGCTC GCCGCAGCCG AACGACCGAG CGCAGCGAGT CAGTGAGCGA GGAAGCGGAA
9361 GAGCGCCCAA TACGCAAACC GCCTCTCCCC GCGCGTTGGC CGATTCATTA ATGCAGCTGG
9421 CACGACAGGT TTCCCGACTG GAAAGCGGGC AGTGAGCGCA ACGCAATTAA TGTGAGTTAC
```

FIG.41E

```
9481  CTCACTCATT AGGCACCCCA GGCTTTACAC TTTATGCTTC CGGCTCCTAT GTTGTGTGGA
9541  ATTGTGAGCG ATAACAATT  TCACACAGGA AACAGCTATG ACCATGATTA CGCCAAGCTC
9601  GGAATTAACC CTCACTAAAG GGAACAAAAG CTGGTACCGA TCCCGAGCTT TGCAAATTAA
9661  AGCCTTCGAG CGTCCCAAAA CCTTCTCAAG CAAGGTTTTC AGTATAATGT TACATGCGTA
9721  CACGCGTCTG TACAGAAAAA AAAGAAAAAT TTGAAATATA ATAACGTTC  TTAATACTAA
9781  CATAACTATA AAAAAATAAA TAGGGACCTA GACTTCAGGT TGTCTAACTC CTTCCTTTTC
9841  GGTTAGAGCG ATGTGGGGG  GAGGGCGTGA ATGTAAGCGT GACATAACTA ATTACATGAT
9901  ATCGACAAAG GAAAAGGGGC CTGTTTACTC ACAGGCTTTT TTCAAGTAGG TAATTAAGTC
9961  GTTTCTGTCT TTTTCCTTCT TCAACCCACC AAAGGCCATC TTGGTACTTT TTTTTTTTTT
10021 TTTTTTTTTT TTTTTTTTTT TTTTTTTTT  TTTTTTTTT  TTTTTTTTTT TTTTTTTTT
10081 TTTTTTTTTT TTTTTTTTTT TCATAGAAAT AATACAGAAG TAGATGTTGA ATTAGATTAA
10141 ACTGAAGATA TATAATTTAT TGGAAAATAC ATAGAGCTTT TTGTTGATGC GCTTAAGCGA
10201 TCAATTCAAC AACACCACCA GCAGCTCTGA TTTTTTCTTC AGCCAACTTG GAGACGAATC
10261 TAGCTTTGAC GATAACTGGA ACATTTGGAA TTCTACCCTT ACCCAAGATC TTACCGTAAC
10321 CGGCTGCCAA AGTGTCAATA ACTGGAGCAG TTTCCTTAGA AGCAGATTTC AAGTATTGGT
10381 CTCTCTTGTC TTCTGGGATC AATGTCCACA ATTTGTCCAA GTTCAAGACT GGCTTCCAGA
10441 AATGAGCTTG TTGCTTGTGG AAGTATCTCA TACCAACCTT ACCGAAATAA CCTGGATGGT
10501 ATTTATCCAT GTTAATTCTG TGGTGATGTT GACCACCGGC CATACCTCTA CCACCGGGGT
10561 GCTTTCTGTG CTTACCGATA CGACCTTTAC CGGCTGAGAC GTGACCTCTG TGCTTTCTAG
10621 TCTTAGTGAA TCTGGAAGGC ATTCTTGATT AGTTGGATGA TTGTTCTGGG ATTTAATGCA
10681 AAAATCACTT AAGAAGGAAA ATCAACGGAG AAAGCAAACG CCATCTTAAA TATACGGGAT
10741 ACAGATGAAA GGGTTTGAAC CTATCTGGAA AATAGCATTA AACAAGCGAA AAACTGCGAG
10801 GAAAATTGTT TGCGTCTCTG CGGGCTATTC ACGCGCCAGA GGAAAATAGG AAAAATAACA
10861 GGGCATTAGA AAAATAATTT TGATTTTGGT AATGTGTGGG TCCTGGTGTA CAGATGTTAC
10921 ATTGGTTACA GTACTCTTGT TTTTGCTGTG TTTTTCGATG AATCTCCAAA ATGGTTGTTA
10981 GCACATGGAA GAGTCACCGA TGCTAAGTTA TCTCTATGTA AGCTACGTGG CGTGACTTTT
11041 GATGAAGCCG CACAAGAGAT ACAGGATTGG CAACTGCAAA TAGAATCTGG GGATCCCCCC
11101 TCGAGATCCG GGATCGAAGA AATGATGGTA AATGAAATAG GAAATCAAGG AGCATGAAGG
11161 CAAAAGACAA ATATAAGGGT CGAACGAAAA ATAAAGTGAA AAGTGTTGAT ATGATGTATT
11221 TGGCTTTGCG GCGCCGAAAA AACGAGTTTA CGCAATTGCA CAATCATGCT GACTCTGTGG
11281 CGGACCCGCG CTCTTGCCGG CCCGGCGATA ACGCTGGGCG TGAGGCTGTG CCCGGCGGAG
11341 TTTTTTGCGC CTGCATTTTC CAAGGTTTAC CCTGCGCTAA GGGGCGAGAT TGGAGAAGCA
11401 ATAAGAATGC CGGTTGGGGT TGCGATGATG ACGACCACGA CAACTGGTGT CATTATTTAA
11461 GTTGCCGAAA GAACCTGAGT GCATTTGCAA CATGAGTATA CTAGAAGAAT GAGCCAAGAC
11521 TTGCGAGACG CGAGTTTGCC GGTGGTGCGA ACAATAGAGC GACCATGACC TTGAAGGTGA
11581 GACGCGCATA ACCGCTAGAG TACTTTGAAG AGGAAACAGC AATAGGGTTG CTACCAGTAT
11641 AAATAGACAG GTACATACAA CACTGGAAAT GGTTGTCTGT TTGAGTACGC TTTCAATTCA
11701 TTTGGGTGTG CAC
```

FIG. 41F pDEST22 8923 bp

| Location (Base Nos.) | Gene Encoded |
|---|---|
| 904..1248 | GAL4 AD |
| 1388..1264 | attR1 |
| 1638..2297 | CmR |
| 2417..2501 | inactivated ccdA |
| 2639..2944 | ccdB |
| 2985..3109 | attR2 |
| 3831..4318 | f1 (f1 intergenic region) |
| 4334..5176 | TRP1 |
| 6110..7194 | ampR |
| 8344..866 | pADH (yeast ADH promoter) |

```
   1 TTCATTTGGG TGTGCACTTT ATTATGTTAC AATATGGAAG GGAACTTTAC ACTTCTCCTA
  61 TGCACATATA TTAATTAAAG TCCAATGCTA GTAGAGAAGG GGGGTAACAC CCCTCCGCGC
 121 TCTTTTCCGA TTTTTTTCTA AACCGTGGAA TATTTCGGAT ATCCTTTTGT TGTTTCCGGG
 181 TGTACAATAT GGACTTCCTC TTTTCTGGCA ACCAAACCCA TACATCGGGA TTCCTATAAT
 241 ACCTTCGTTG GTCTCCCTAA CATGTAGGTG GCGGAGGGGA GATATACAAT AGAACAGATA
 301 CCAGACAAGA CATAATGGGC TAAACAAGAC TACACCAATT ACACTGCCTC ATTGATGGTG
 361 GTACATAACG AACTAATACT GTAGCCCTAG ACTTGATAGC CATCATCATA TCGAAGTTTC
 421 ACTACCCTTT TTCCATTTGC CATCTATTGA AGTAATAATA GGCGCATGCA ACTTCTTTTC
 481 TTTTTTTTTC TTTTCTCTCT CCCCCGTTGT TGTCTCACCA TATCCGCAAT GACAAAAAAA
 541 ATGATGGAAG ACACTAAAGG AAAAAATTAA CGACAAAGAC AGCACCAACA GATGTCGTTG
 601 TTCCAGAGCT GATGAGGGGT ATCTTCGAAC ACACGAAACT TTTTCCTTCC TTCATTCACG
 661 CACACTACTC TCTAATGAGC AACGGTATAC GGCCTTCCTT CCAGTTACTT GAATTTGAAA
 721 TAAAAAAAGT TTGCCGCTTT GCTATCAAGT ATAAATAGAC CTGCAATTAT TAATCTTTTG
 781 TTTCCTCGTC ATTGTTCTCG TTCCCTTTCT TCCTTGTTTC TTTTTCTGCA CAATATTTCA
 841 AGCTATACCA AGCATACAAT CAACTCCAAG CTTATGCCCA AGAAGAAGCG GAAGGTCTCG
 901 AGCGGCGCCA ATTTTAATCA AAGTGGGAAT ATTGCTGATA GCTCATTGTC CTTCACTTTC
 961 ACTAACAGTA GCAACGGTCC GAACCTCATA ACAACTCAAA CAAATTCTCA AGCGCTTTCA
1021 CAACCAATTG CCTCCTCTAA CGTTCATGAT AACTTCATGA ATAATGAAAT CACGGCTAGT
1081 AAAATTGATG ATGGTAATAA TTCAAAACAC CTGCACCTG GTTGGACGGA CCAAACTGCG
1141 TATAACGCGT TTGGAATCAC TACAGGGATG TTTAATACCA CTACAATGGA TGATGTATAT
1201 AACTATCTAT TCGATGATGA AGATACCCCA CCAAACCCAA AAAAAGAGGG TGGGTCGAAT
1261 CAAACAAGTT TGTACAAAAA AGCTGAACGA GAAACGTAAA ATGATATAAA TATCAATATA
1321 TTAAATTAGA TTTTGCATAA AAAACAGACT ACATAATACT GTAAAACACA ACATATCCAG
1381 TCACTATGGC GGCCGCTAAG TTGGCAGCAT CACCCGACGC ACTTTGCGCC GAATAAATAC
1441 CTGTGACGGA AGATCACTTC GCAGAATAAA TAAATCCTGG TGTCCCTGTT GATACCGGGA
1501 AGCCCTGGGC CAACTTTTGG CGAAAATGAG ACGTTGATCG GCACGTAAGA GGTTCCAACT
1561 TTCACCATAA TGAAATAAGA TCACTACCGG GCGTATTTTT TGAGTTATCG AGATTTTCAG
1621 GAGCTAAGGA AGCTAAAATG GAGAAAAAAA TCACTGGATA TACCACCGTT GATATATCCC
1681 AATGGCATCG TAAAGAACAT TTTGAGGCAT TTCAGTCAGT TGCTCAATGT ACCTATAACC
1741 AGACCGTTCA GCTGGATATT ACGGCCTTTT TAAAGACCGT AAAGAAAAAT AAGCACAAGT
1801 TTTATCCGGC CTTTATTCAC ATTCTTGCCC GCCTGATGAA TGCTCATCCG GAATTCCGTA
```

FIG.42B

```
1861 TGGCAATGAA AGACGGTGAG CTGGTGATAT GGGATAGTGT TCACCCTTGT TACACCGTTT
1921 TCCATGAGCA AACTGAAACG TTTTCATCGC TCTGGAGTGA ATACCACGAC GATTTCCGGC
1981 AGTTTCTACA CATATATTCG CAAGATGTGG CGTGTTACGG TGAAAACCTG GCCTATTTCC
2041 CTAAAGGGTT TATTGAGAAT ATGTTTTTCG TCTCAGCCAA TCCCTGGGTG AGTTTCACCA
2101 GTTTTGATTT AAACGTGGCC AATATGGACA ACTTCTTCGC CCCCGTTTTC ACCATGGGCA
2161 AATATTATAC GCAAGGCGAC AAGGTGCTGA TGCCGCTGGC GATTCAGGTT CATCATGCCG
2221 TCTGTGATGG CTTCCATGTC GGCAGAATGC TTAATGAATT ACAACAGTAC TGCGATGAGT
2281 GGCAGGGCGG GGCGTAATCT AGAGGATCCG GCTTACTAAA AGCCAGATAA CAGTATGCGT
2341 ATTTGCGCGC TGATTTTTGC GGTATAAGAA TATATACTGA TATGTATACC CGAAGTATGT
2401 CAAAAAGAGG TGTGCTATGA AGCAGCGTAT TACAGTGACA GTTGACAGCG ACAGCTATCA
2461 GTTGCTCAAG GCATATATGA TGTCAATATC TCCGGTCTGG TAAGCACAAC CATGCAGAAT
2521 GAAGCCCGTC GTCTGCGTGC CGAACGCTGG AAAGCGGAAA ATCAGGAAGG GATGGCTGAG
2581 GTCGCCCGGT TTATTGAAAT GAACGGCTCT TTTGCTGACG AGAACAGGGA CTGGTGAAAT
2641 GCAGTTTAAG GTTTACACCT ATAAAAGAGA GAGCCGTTAT CGTCTGTTTG TGGATGTACA
2701 GAGTGATATT ATTGACACGC CCGGGCGACG GATGGTGATC CCCCTGGCCA GTGCACGTCT
2761 GCTGTCAGAT AAAGTCTCCC GTGAACTTTA CCCGGTGGTG CATATCGGGG ATGAAAGCTG
2821 GCGCATGATG ACCACCGATA TGGCCAGTGT GCCGGTCTCC GTTATCGGGG AAGAAGTGGC
2881 TGATCTCAGC CACCGCGAAA ATGACATCAA AAACGCCATT AACCTGATGT TCTGGGGAAT
2941 ATAAATGTCA GGCTCCCTTA TACACAGCCA GTCTGCAGGT CGACCATAGT GACTGGATAT
3001 GTTGTGTTTT ACAGTATTAT GTAGTCTGTT TTTTATGCAA AATCTAATTT AATATATTGA
3061 TATTTATATC ATTTTACGTT TCTCGTTCAG CTTTCTTGTA CAAAGTGGTT TGATGGCCGC
3121 TAAGTAAGTA AGACGTCGAG CTCTAAGTAA GTAACGGCCG CCACCGCGGT GGAGCTTTGG
3181 ACTTCTTCGC CAGAGGTTTG GTCAAGTCTC CAATCAAGGT TGTCGGCTTG TCTACCTTGC
3241 CAGAAATTTA CGAAAAGATG GAAAAGGGTC AAATCGTTGG TAGATACGTT GTTGACACTT
3301 CTAAATAAGC GAATTTCTTA TGATTTATGA TTTTTATTAT TAAATAAGTT ATAAAAAAAA
3361 TAAGTGTATA CAAATTTTAA AGTGACTCTT AGGTTTTAAA ACGAAAATTC TTATTCTTGA
3421 GTAACTCTTT CCTGTAGGTC AGGTTGCTTT CTCAGGTATA GCATGAGGTC GCTCTTATTG
3481 ACCACACCTC TACCGGCATG CCGAGCAAAT GCCTGCAAAT CGCTCCCCAT TTCACCCAAT
3541 TGTAGATATG CTAACTCCAG CAATGAGTTG ATGAATCTCG GTGTGTATTT TATGTCCTCA
3601 GAGGACAATA CCTGTTGTAA TCGTTCTTCC ACACGGATCC CAATTCGCCC TATAGTGAGT
3661 CGTATTACAA TTCACTGGCC GTCGTTTTAC AACGTCGTGA CTGGGAAAAC CCTGGCGTTA
3721 CCCAACTTAA TCGCCTTGCA GCACATCCCC CTTTCGCCAG CTGGCGTAAT AGCGAAGAGG
3781 CCCGCACCGA TCGCCCTTCC CAACAGTTGC GCAGCCTGAA TGGCGAATGG ACGCGCCCTG
3841 TAGCGGCGCA TTAAGCGCGG CGGGTGTGGT GGTTACGCGC AGCGTGACCG CTACACTTGC
3901 CAGCGCCCTA GCGCCCGCTC CTTTCGCTTT CTTCCCTTCC TTTCTCGCCA CGTTCGCCGG
3961 CTTTCCCCGT CAAGCTCTAA ATCGGGGGCT CCCTTTAGGG TTCCGATTTA GTGCTTTACG
4021 GCACCTCGAC CCCAAAAAAC TTGATTAGGG TGATGGTTCA CGTAGTGGGC CATCGCCCTG
4081 ATAGACGGTT TTTCGCCCTT TGACGTTGGA GTCCACGTTC TTTAATAGTG GACTCTTGTT
4141 CCAAACTGGA ACAACACTCA ACCCTATCTC GGTCTATTCT TTTGATTTAT AAGGGATTTT
4201 GCCGATTTCG GCCTATTGGT TAAAAAATGA GCTGATTTAA CAAAAATTTA ACGCGAATTT
4261 TAACAAAATA TTAACGTTTA CAATTTCCTG ATGCGGTATT TTCTCCTTAC GCATCTGTGC
4321 GGTATTTCAC ACCGCAGGCA AGTGCACAAA CAATACTTAA ATAAATACTA CTCAGTAATA
4381 ACCTATTTCT TAGCATTTTT GACGAAATTT GCTATTTTGT TAGAGTCTTT TACACCATTT
```

FIG.42C

```
4441 GTCTCCACAC CTCCGCTTAC ATCAACACCA ATAACGCCAT TTAATCTAAG CGCATCACCA
4501 ACATTTTCTG GCGTCAGTCC ACCAGCTAAC ATAAAATGTA AGCTTTCGGG GCTCTCTTGC
4561 CTTCCAACCC AGTCAGAAAT CGAGTTCCAA TCCAAAAGTT CACCTGTCCC ACCTGCTTCT
4621 GAATCAAACA AGGGAATAAA CGAATGAGGT TTCTGTGAAG CTGCACTGAG TAGTATGTTG
4681 CAGTCTTTTG GAAATACGAG TCTTTTAATA ACTGGCAAAC CGAGGAACTC TTGGTATTCT
4741 TGCCACGACT CATCTCCATG CAGTTGGACG ATATCAATGC CGTAATCATT GACCAGAGCC
4801 AAAACATCCT CCTTAGGTTG ATTACGAAAC ACGCCAACCA AGTATTTCGG AGTGCCTGAA
4861 CTATTTTTAT ATGCTTTTAC AAGACTTGAA ATTTTCCTTG CAATAACCGG GTCAATTGTT
4921 CTCTTTCTAT TGGGCACACA TATAATACCC AGCAAGTCAG CATCGGAATC TAGAGCACAT
4981 TCTGCGGCCT CTGTGCTCTG CAAGCCGCAA ACTTTCACCA ATGGACCAGA ACTACCTGTG
5041 AAATTAATAA CAGACATACT CCAAGCTGCC TTTGTGTGCT TAATCACGTA TACTCACGTG
5101 CTCAATAGTC ACCAATGCCC TCCCTCTTGG CCCTCTCCTT TTCTTTTTTC GACCGAATTA
5161 ATTCTTAATC GGCAAAAAAA GAAAAGCTCC GGATCAAGAT TGTACGTAAG GTGACAAGCT
5221 ATTTTTCAAT AAAGAATATC TTCCACTACT GCCATCTGGC GTCATAACTG CAAAGTACAC
5281 ATATATTACG ATGCTGTCTA TTAAATGCTT CCTATATTAT ATATATAGTA ATGTCGTTTA
5341 TGGTGCACTC TCAGTACAAT CTGCTCTGAT GCCGCATAGT TAAGCCAGCC CCGACACCCG
5401 CCAACACCCG CTGACGCGCC CTGACGGGCT TGTCTGCTCC CGGCATCCGC TTACAGACAA
5461 GCTGTGACCG TCTCCGGGAG CTGCATGTGT CAGAGGTTTT CACCGTCATC ACCGAAACGC
5521 GCGAGACGAA AGGGCCTCGT GATACGCCTA TTTTTATAGG TTAATGTCAT GATAATAATG
5581 GTTTCTTAGG ACGGATCGCT TGCCTGTAAC TTACACGCGC CTCGTATCTT TTAATGATGG
5641 AATAATTTGG GAATTTACTC TGTGTTTATT TATTTTTATG TTTTGTATTT GGATTTTAGA
5701 AAGTAAATAA AGAAGGTAGA AGAGTTACGG AATGAAGAAA AAAAAATAAA CAAAGGTTTA
5761 AAAAATTTCA ACAAAAAGCG TACTTTACAT ATATATTTAT TAGACAAGAA AAGCAGATTA
5821 AATAGATATA CATTCGATTA ACGATAAGTA AAATGTAAAA TCACAGGATT TTCGTGTGTG
5881 GTCTTCTACA CAGACAAGAT GAAACAATTC GGCATTAATA CCTGAGAGCA GGAAGAGCAA
5941 GATAAAAGGT AGTATTTGTT GGCGATCCCC CTAGAGTCTT TTACATCTTC GGAAAACAAA
6001 AACTATTTTT TCTTTAATTT CTTTTTTTAC TTTCTATTTT TAATTTATAT ATTTATATTA
6061 AAAAATTTAA ATTATAATTA TTTTTATAGC ACGTGATGAA AAGGACCCAG GTGGCACTTT
6121 TCGGGGAAAT GTGCGCGGAA CCCCTATTTG TTTATTTTTC TAAATACATT CAAATATGTA
6181 TCCGCTCATG AGACAATAAC CCTGATAAAT GCTTCAATAA TATTGAAAAA GGAAGAGTAT
6241 GAGTATTCAA CATTTCCGTG TCGCCCTTAT TCCCTTTTTT GCGGCATTTT GCCTTCCTGT
6301 TTTTGCTCAC CCAGAAACGC TGGTGAAAGT AAAAGATGCT GAAGATCAGT TGGGTGCACG
6361 AGTGGGTTAC ATCGAACTGG ATCTCAACAG CGGTAAGATC CTTGAGAGTT TTCGCCCCGA
6421 AGAACGTTTT CCAATGATGA GCACTTTTAA AGTTCTGCTA TGTGGCGCGG TATTATCCCG
6481 TATTGACGCC GGGCAAGAGC AACTCGGTCG CCGCATACAC TATTCTCAGA ATGACTTGGT
6541 TGAGTACTCA CCAGTCACAG AAAAGCATCT TACGGATGGC ATGACAGTAA GAGAATTATG
6601 CAGTGCTGCC ATAACCATGA GTGATAACAC TGCGGCCAAC TTACTTCTGA CAACGATCGG
6661 AGGACCGAAG GAGCTAACCG CTTTTTTTCA CAACATGGGG GATCATGTAA CTCGCCTTGA
6721 TCGTTGGGAA CCGGAGCTGA ATGAAGCCAT ACCAAACGAC GAGCGTGACA CCACGATGCC
6781 TGTAGCAATG GCAACAACGT TGCGCAAACT ATTAACTGGC GAACTACTTA CTCTAGCTTC
6841 CCGGCAACAA TTAATAGACT GGATGGAGGC GGATAAAGTT GCAGGACCAC TTCTGCGCTC
6901 GGCCCTTCCG GCTGGCTGGT TTATTGCTGA TAAATCTGGA GCCGGTGAGC GTGGGTCTCG
6961 CGGTATCATT GCAGCACTGG GGCCAGATGG TAAGCCCTCC CGTATCGTAG TTATCTACAC
```

FIG.42D

```
7021 GACGGGCAGT CAGGCAACTA TGGATGAACG AAATAGACAG ATCGCTGAGA TAGGTGCCTC
7081 ACTGATTAAG CATTGGTAAC TGTCAGACCA AGTTTACTCA TATATACTTT AGATTGATTT
7141 AAAACTTCAT TTTTAATTTA AAAGGATCTA GGTGAAGATC CTTTTTGATA ATCTCATGAC
7201 CAAAATCCCT TAACGTGAGT TTTCGTTCCA CTGAGCGTCA GACCCCGTAG AAAAGATCAA
7261 AGGATCTTCT TGAGATCCTT TTTTTCTGCG CGTAATCTGC TGCTTGCAAA CAAAAAAACC
7321 ACCGCTACCA GCGGTGGTTT GTTTGCCGGA TCAAGAGCTA CCAACTCTTT TTCCGAAGGT
7381 AACTGGCTTC AGCAGAGCGC AGATACCAAA TACTGTCCTT CTAGTGTAGC CGTAGTTAGG
7441 CCACCACTTC AAGAACTCTG TAGCACCGCC TACATACCTC GCTCTGCTAA TCCTGTTACC
7501 AGTGGCTGCT GCCAGTGGCG ATAAGTCGTG TCTTACCGGG TTGGACTCAA GACGATAGTT
7561 ACCGGATAAG GCGCAGCGGT CGGGCTGAAC GGGGGGTTCG TGCACACAGC CCAGCTTGGA
7621 GCGAACGACC TACACCGAAC TGAGATACCT ACAGCGTGAG CATTGAGAAA GCGCCACGCT
7681 TCCCGAAGGG AGAAAGGCGG ACAGGTATCC GGTAAGCGGC AGGGTCGGAA CAGGAGAGCG
7741 CACGAGGGAG CTTCCAGGGG GAACGCCTG GTATCTTTAT AGTCCTGTCG GGTTTCGCCA
7801 CCTCTGACTT GAGCGTCGAT TTTTGTGATG CTCGTCAGGG GGGCCGAGCC TATGGAAAAA
7861 CGCCAGCAAC GCGGCCTTTT TACGGTTCCT GGCCTTTTGC TGGCCTTTTG CTCACATGTT
7921 CTTTCCTGCG TTATCCCCTG ATTCTGTGGA TAACCGTATT ACCGCCTTTG AGTGAGCTGA
7981 TACCGCTCGC CGCAGCCGAA CGACCGAGCG CAGCGAGTCA GTGAGCGAGG AAGCGGAAGA
8041 GCGCCCAATA CGCAAACCGC CTCTCCCCGC GCGTTGGCCG ATTCATTAAT GCAGCTGGCA
8101 CGACAGGTTT CCCGACTGGA AAGCGGGCAG TGAGCGCAAC GCAATTAATG TGAGTTACCT
8161 CACTCATTAG GCACCCCAGG CTTTACACTT TATGCTTCCG GCTCCTATGT TGTGTGGAAT
8221 TGTGAGCGGA TAACAATTTC ACACAGGAAA CAGCTATGAC CATGATTACG CCAAGCTCGG
8281 AATTAACCCT CACTAAAGGG AACAAAAGCT GGGTACCGGG CCCCCCCTCG AGATCCGGGA
8341 TCGAAGAAAT GATGGTAAAT GAAATAGGAA ATCAAGGAGC ATGAAGGCAA AAGACAAATA
8401 TAAGGGTCGA ACGAAAAATA AAGTGAAAAG TGTTGATATG ATGTATTTGG CTTTGCGGCG
8461 CCGAAAAAAC GAGTTTACGC AATTGCACAA TCATGCTGAC TCTGTGGCGG ACCCGCGCTC
8521 TTGCCGGCCC GGCGATAACG CTGGGCGTGA GGCTGTGCCC GGCGGAGTTT TTTGCGCCTG
8581 CATTTTTCCAA GGTTTACCCT GCGCTAAGGG GCGAGATTGG AGAAGCAATA AGAATGCCGG
8641 TTGGGGTTGC GATGATGACG ACCACGACAA CTGGTGTCAT TATTTAAGTT GCCGAAAGAA
8701 CCTGAGTGCA TTTGCAACAT GAGTATACTA GAAGAATGAG CCAAGACTTG CGAGACGCGA
8761 GTTTGCCGGT GGTGCGAACA ATAGAGCGAC CATGACCTTG AAGGTGAGAC GCGCATAACC
8821 GCTAGAGTAC TTTGAAGAGG AAACAGCAAT AGGGTTGCTA CCAGTATAAA TAGACAGGTA
8881 CATACAACAC TGGAAATGGT TGTCTGTTTG AGTACGCTTT CAA
```

FIG.42E pDEST23 6264 bp

| Location (Base Nos.) | Gene Encoded |
|---|---|
| 285..161 | attR1 |
| 394..1053 | CmR |
| 1173..1257 | inactivated ccdA |
| 1395..1700 | ccdB |
| 1741..1865 | attR2 |
| 1883..1911 | his6 |
| 2574..3434 | ampR |
| 3583..4222 | ori |

```
   1 TCTTCCCCAT CGGTGATGTC GGCGATATAG CGCCAGCAA CCGCACCTGT GGCGCCGGTG
  61 ATGCCGGCCA CGATGCGTCC GGCGTAGAGG ATCGAGATCT CGATCCCGCG AAATTAATAC
 121 GACTCACTAT AGGGAGACCA CAACGGTTTC CCTCTAGATC ACAAGTTTGT ACAAAAAAGC
 181 TGAACGAGAA ACGTAAAATG ATATAAATAT CAATATATTA AATTAGATTT TGCATAAAAA
 241 ACAGACTACA TAATACTGTA AAACACAACA TATCCAGTCA CTATGGCGGC CGCATTAGGC
 301 ACCCCAGGCT TTACACTTTA TGCTTCCGGC TCGTATAATG TGTGGATTTT GAGTTAGGAT
 361 CCGGCGAGAT TTTCAGGAGC TAAGGAAGCT AAAATGGAGA AAAAAATCAC TGGATATACC
 421 ACCGTTGATA TATCCCAATG GCATCGTAAA GAACATTTTG AGGCATTTCA GTCAGTTGCT
 481 CAATGTACCT ATAACCAGAC CGTTCAGCTG GATATTACGG CCTTTTTAAA GACCGTAAAG
 541 AAAAATAAGC ACAAGTTTTA TCCGGCCTTT ATTCACATTC TTGCCCGCCT GATGAATGCT
 601 CATCCGGAAT TCCGTATGGC AATGAAAGAC GGTGAGCTGG TGATATGGGA TAGTGTTCAC
 661 CCTTGTTACA CCGTTTTCCA TGAGCAAACT GAAACGTTTT CATCGCTCTG GAGTGAATAC
 721 CACGACGATT TCCGGCAGTT TCTACACATA TATTCGCAAG ATGTGGCGTG TTACGGTGAA
 781 AACCTGGCCT ATTTCCCTAA AGGGTTTATT GAGAATATGT TTTTCGTCTC AGCCAATCCC
 841 TGGGTGAGTT TCACCAGTTT TGATTTAAAC GTGGCCAATA TGGACAACTT CTTCGCCCCC
 901 GTTTTCACCA TGGGCAAATA TTATACGCAA GGCGACAAGG TGCTGATGCC GCTGGCGATT
 961 CAGGTTCATC ATGCCGTCTG TGATGGCTTC CATGTCGGCA GAATGCTTAA TGAATTACAA
1021 CAGTACTGCG ATGAGTGGCA GGGCGGGGCG TAAACGCGTG GATCCGGCTT ACTAAAAGCC
1081 AGATAACAGT ATGCGTATTT GCGCGCTGAT TTTTGCGGTA TAAGAATATA TACTGATATG
1141 TATACCCGAA GTATGTCAAA AAGAGGTGTG CTATGAAGCA GCGTATTACA GTGACAGTTG
1201 ACAGCGACAG CTATCAGTTG CTCAAGGCAT ATATGATGTC AATATCTCCG GTCTGGTAAG
1261 CACAACCATG CAGAATGAAG CCCGTCGTCT GCGTGCCGAA CGCTGGAAAG CGGAAAATCA
1321 GGAAGGGATG GCTGAGGTCG CCCGGTTTAT TGAAATGAAC GGCTCTTTTG CTGACGAGAA
1381 CAGGGACTGG TGAAATGCAG TTTAAGGTTT ACACCTATAA AGAGAGAGC CGTTATCGTC
1441 TGTTTGTGGA TGTACAGAGT GATATTATTG ACACGCCCGG GCGACGGATG GTGATCCCCC
1501 TGGCCAGTGC ACGTCTGCTG TCAGATAAAG TCTCCCGTGA ACTTTACCCG GTGGTGCATA
1561 TCGGGGATGA AAGCTGGCGC ATGATGACCA CCGATATGGC CAGTGTGCCG GTCTCCGTTA
1621 TCGGGGAAGA AGTGGCTGAT CTCAGCCACC GCGAAAATGA CATCAAAAAC GCCATTAACC
1681 TGATGTTCTG GGGAATATAA ATGTCAGGCT CCCTTATACA CAGCCAGTCT GCAGGTCGAC
```

FIG.43B

```
1741 CATAGTGACT GGATATGTTG TGTTTTACAG TATTATGTAG TCTGTTTTTT ATGCAAAATC
1801 TAATTTAATA TATTGATATT TATATCATTT TACGTTTCTC GTTCAGCTTT CTTGTACAAA
1861 GTGGTGATTA TGTCGTACTA CCATCACCAT CACCATCACC TCGATGAGCA ATAACTAGCA
1921 TAACCCCTTG GGGCCTCTAA ACGGGTCTTG AGGGGTTTTT TGCTGAAAGG AGGAACTATA
1981 TCCGGATATC CACAGGACGG GTGTGGTCGC CATGATCGCG TAGTCGATAG TGGCTCCAAG
2041 TAGCGAAGCG AGCAGGACTG GGCGGCGGCC AAAGCGGTCG GACAGTGCTC CGAGAACGGG
2101 TGCGCATAGA AATTGCATCA ACGCATATAG CGCTAGCAGC ACGCCATAGT GACTGGCGAT
2161 GCTGTCGGAA TGGACGATAT CCCGCAAGAG GCCCGGCAGT ACCGGCATAA CCAAGCCTAT
2221 GCCTACAGCA TCCAGGGTGA CGGTGCCGAG GATGACGATG AGCGCATTGT TAGATTTCAT
2281 ACACGGTGCC TGACTGCGTT AGCAATTTAA CTGTGATAAA CTACCGCATT AAAGCTTATC
2341 GATGATAAGC TGTCAAACAT GAGAATTCTT GAAGACGAAA GGGCCTCGTG ATACGCCTAT
2401 TTTTATAGGT TAATGTCATG ATAATAATGG TTTCTTAGAC GTCAGGTGGC ACTTTTCGGG
2461 GAAATGTGCG CGGAACCCCT ATTTGTTTAT TTTTCTAAAT ACATTCAAAT ATGTATCCGC
2521 TCATGAGACA ATAACCCTGA TAAATGCTTC AATAATATTG AAAAAGGAAG AGTATGAGTA
2581 TTCAACATTT CCGTGTCGCC CTTATTCCCT TTTTTGCGGC ATTTTGCCTT CCTGTTTTTG
2641 CTCACCCAGA AACGCTGGTG AAAGTAAAAG ATGCTGAAGA TCAGTTGGGT GCACGAGTGG
2701 GTTACATCGA ACTGGATCTC AACAGCGGTA AGATCCTTGA GAGTTTTCGC CCCGAAGAAC
2761 GTTTTCCAAT GATGAGCACT TTTAAAGTTC TGCTATGTGG CGCGGTATTA TCCCGTGTTG
2821 ACGCCGGGCA AGAGCAACTC GGTCGCCGCA TACACTATTC TCAGAATGAC TTGGTTGAGT
2881 ACTCACCAGT CACAGAAAAG CATCTTACGG ATGGCATGAC AGTAAGAGAA TTATGCAGTG
2941 CTGCCATAAC CATGAGTGAT AACACTGCGG CCAACTTACT TCTGACAACG ATCGGAGGAC
3001 CGAAGGAGCT AACCGCTTTT TTGCACAACA TGGGGGATCA TGTAACTCGC CTTGATCGTT
3061 GGGAACCGGA GCTGAATGAA GCCATACCAA ACGACGAGCG TGACACCACG ATGCCTGCAG
3121 CAATGGCAAC AACGTTGCGC AAACTATTAA CTGGCGAACT ACTTACTCTA GCTTCCCGGC
3181 AACAATTAAT AGACTGGATG GAGGCGGATA AAGTTGCAGG ACCACTTCTG CGCTCGGCCC
3241 TTCCGGCTGG CTGGTTTATT GCTGATAAAT CTGGAGCCGG TGAGCGTGGG TCTCGCGGTA
3301 TCATTGCAGC ACTGGGGCCA GATGGTAAGC CCTCCCGTAT CGTAGTTATC TACACGACGG
3361 GGAGTCAGGC AACTATGGAT GAACGAAATA GACAGATCGC TGAGATAGGT GCCTCACTGA
3421 TTAAGCATTG GTAACTGTCA GACCAAGTTT ACTCATATAT ACTTTAGATT GATTTAAAAC
3481 TTCATTTTTA ATTTAAAAGG ATCTAGGTGA AGATCCTTTT TGATAATCTC ATGACCAAAA
3541 TCCCTTAACG TGAGTTTTCG TTCCACTGAG CGTCAGACCC CGTAGAAAAG ATCAAAGGAT
3601 CTTCTTGAGA TCCTTTTTTT CTGCGCGTAA TCTGCTGCTT GCAAACAAAA AAACCACCGC
3661 TACCAGCGGT GGTTTGTTTG CCGGATCAAG AGCTACCAAC TCTTTTTCCG AAGGTAACTG
3721 GCTTCAGCAG AGCGCAGATA CCAAATACTG TCCTTCTAGT GTAGCCGTAG TTAGGCCACC
3781 ACTTCAAGAA CTCTGTAGCA CCGCCTACAT ACCTCGCTCT GCTAATCCTG TTACCAGTGG
3841 CTGCTGCCAG TGGCGATAAG TCGTGTCTTA CCGGGTTGGA CTCAAGACGA TAGTTACCGG
3901 ATAAGGCGCA GCGGTCGGGC TGAACGGGGG GTTCGTGCAC ACAGCCCAGC TTGGAGCGAA
3961 CGACCTACAC CGAACTGAGA TACCTACAGC GTGAGCTATG AGAAAGCGCC ACGCTTCCCG
4021 AAGGGAGAAA GGCGGACAGG TATCCGGTAA GCGGCAGGGT CGGAACAGGA GAGCGCACGA
```

FIG.43C

```
4081 GGGAGCTTCC AGGGGGAAAC GCCTGGTATC TTTATAGTCC TGTCGGGTTT CGCCACCTCT
4141 GACTTGAGCG TCGATTTTTG TGATGCTCGT CAGGGGGGCG GAGCCTATGG AAAAACGCCA
4201 GCAACGCGGC CTTTTTACGG TTCCTGGCCT TTTGCTGGCC TTTTGCTCAC ATGTTCTTTC
4261 CTGCGTTATC CCCTGATTCT GTGGATAACC GTATTACCGC CTTTGAGTGA GCTGATACCG
4321 CTCGCCGCAG CCGAACGACC GAGCGCAGCG AGTCAGTGAG CGAGGAAGCG AAGAGCGCC
4381 TGATGCGGTA TTTTCTCCTT ACGCATCTGT GCGGTATTTC ACACCGCATA TATGGTGCAC
4441 TCTCAGTACA ATCTGCTCTG ATGCCGCATA GTTAAGCCAG TATACACTCC GCTATCGCTA
4501 CGTGACTGGG TCATGGCTGC GCCCCGACAC CCGCCAACAC CCGCTGACGC GCCCTGACGG
4561 GCTTGTCTGC TCCCGGCATC CGCTTACAGA CAAGCTGTGA CCGTCTCCGG GAGCTGCATG
4621 TGTCAGAGGT TTTCACCGTC ATCACCGAAA CGCGCGAGGC AGCTGCGGTA AAGCTCATCA
4681 GCGTGGTCGT GAAGCGATTC ACAGATGTCT GCCTGTTCAT CCGCGTCCAG CTCGTTGAGT
4741 TTCTCCAGAA GCGTTAATGT CTGGCTTCTG ATAAAGCGGG CCATGTTAAG GCGGTTTTTT
4801 TCCTGTTTGG TCACTGATGC CTCCGTGTAA GGGGGATTTC TGTTCATGGG GGTAATGATA
4861 CCGATGAAAC GAGAGAGGAT GCTCACGATA CGGGTTACTG ATGATGAACA TGCCCGGTTA
4921 CTGGAACGTT GTGAGGGTAA ACAACTGGCG GTATGGATGC GGCGGGACCA GAGAAAAATC
4981 ACTCAGGGTC AATGCCAGCG CTTCGTTAAT ACAGATGTAG GTGTTCCACA GGGTAGCCAG
5041 CAGCATCCTG CGATGCAGAT CCGGAACATA ATGGTGCAGG GCGCTGACTT CCGCGTTTCC
5101 AGACTTTACG AAACACGGAA ACCGAAGACC ATTCATGTTG TTGCTCAGGT CGCAGACGTT
5161 TTGCAGCAGC AGTCGCTTCA CGTTCGCTCG CGTATCGGTG ATTCATTCTG CTAACCAGTA
5221 AGGCAACCCC GCCAGCCTAG CCGGGTCCTC AACGACAGGA GCACGATCAT GCGCACCCGT
5281 GGCCAGGACC CAACGCTGCC CGAGATGCGC CGCGTGCGGC TGCTGGAGAT GGCGGACGCG
5341 ATGGATATGT TCTGCCAAGG GTTGGTTTGC GCATTCACAG TTCTCCGCAA GAATTGATTG
5401 GCTCCAATTC TTGGAGTGGT GAATCCGTTA GCGAGGTGCC GCCGGCTTCC ATTCAGGTCG
5461 AGGTGGCCCG GCTCCATGCA CCGCGACGCA ACGCGGGGAG GCAGACAAGG TATAGGGCGG
5521 CGCCTACAAT CCATGCCAAC CCGTTCCATG TGCTCGCCGA GGCGGCATAA ATCGCCGTGA
5581 CGATCAGCGG TCCAGTGATC GAAGTTAGGC TGGTAAGAGC CGCGAGCGAT CCTTGAAGCT
5641 GTCCCTGATG GTCGTCATCT ACCTGCCTGG ACAGCATGGC CTGCAACGCG GGCATCCCGA
5701 TGCCGCCGGA AGCGAGAAGA ATCATAATGG GGAAGGCCAT CCAGCCTCGC GTCGCGAACG
5761 CCAGCAAGAC GTAGCCCAGC GCGTCGGCCG CCATGCCGGC GATAATGGCC TGCTTCTCGC
5821 CGAAACGTTT GGTGGCGGGA CCAGTGACGA AGGCTTGAGC GAGGGCGTGC AAGATTCCGA
5881 ATACCGCAAG CGACAGGCCG ATCATCGTCG CGCTCCAGCG AAAGCGGTCC TCGCCGAAAA
5941 TGACCCAGAG CGCTGCCGGC ACCTGTCCTA CGAGTTGCAT GATAAAGAAG ACAGTCATAA
6001 GTGCGGCGAC GATAGTCATG CCCCGCGCCC ACCGGAAGGA GCTGACTGGG TTGAAGGCTC
6061 TCAAGGGCAT CGGTCGATCG ACGCTCTCCC TTATGCGACT CCTGCATTAG GAAGCAGCCC
6121 AGTAGTAGGT TGAGGCCGTT GAGCACCGCC GCCGCAAGGA ATGGTGCATG CAAGGAGATG
6181 GCGCCCAACA GTCCCCCGGC CACGGGGCCT GCCACCATAC CCACGCCGAA ACAAGCGCTC
6241 ATGAGCCCGA AGTGGCGAGC CCGA
```

FIG.43D pDEST24
GST CARBOXY-FUSION VECTOR, T7 PROMOTER

```
                                         T7 PROMOTER              ──→ mRNA
1   atc gag atc tcg atc ccg cga aat  taa tac gac tca cta tag gga  gac cac
    tag ctc tag agc tag ggc gct tta  att atg ctg agt gat atc cct  ctg gtg Int              attR1
52  aac ggt ttc cct cta gat cac aag ttt gta caa aaa agc tga acg aga aac
    ttg cca aag gga gat cta gtg ttc aaa cat gtt ttt tcg act tgc tct ttg
    ├──────────── CmR ────────────┤├───────── ccdB ─────────────┤ attR2              A  F  L  Y  K  V  V  I  M  S
1735 tca ttt tac gtt tct cgt tca gct ttc ttg tac aaa gtg gtg att atg tcc
     agt aaa atg caa aga gca agt cga aag aac atg ttt cac cac taa tac agg
    ├────────────

P  I  L ─────── GST PROTEIN ────→      (~223 aa)
1786 cct ata cta ggt tat tgg aaa att aag ggc ctt gtg caa ccc act cga ctt
     gga tat gat cca ata acc ttt taa ttc ccg gaa cac gtt ggg tga gct gaa
```

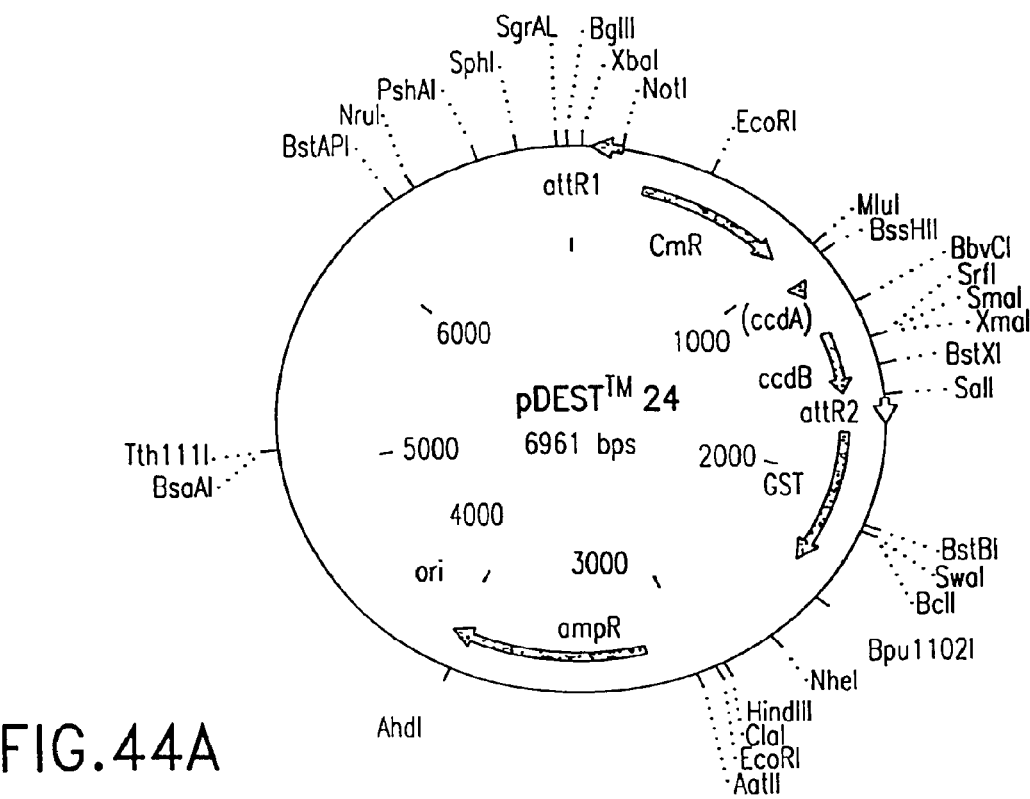

FIG. 44A pDEST24 6961 bp

| Location (Base Nos.) | Gene Encoded |
|---|---|
| 195..71 | attR1 |
| 304..963 | CmR |
| 1083..1167 | inactivated ccdA |
| 1305..1610 | ccdB |
| 1651..1775 | attR2 |
| 1783..2451 | GST |
| 3181..4041 | ampR |
| 4190..4829 | ori |

```
   1 ATCGAGATCT CGATCCCGCG AAATTAATAC GACTCACTAT AGGGAGACCA CAACGGTTTC
  61 CCTCTAGATC ACAAGTTTGT ACAAAAAAGC TGAACGAGAA ACGTAAAATG ATATAAATAT
 121 CAATATATTA AATTAGATTT TGCATAAAAA ACAGACTACA TAATACTGTA AAACACAACA
 181 TATCCAGTCA CTATGGCGGC CGCATTAGGC ACCCCAGGCT TTACACTTTA TGCTTCCGGC
 241 TCGTATAATG TGTGGATTTT GAGTTAGGAT CCGGCGAGAT TTTCAGGAGC TAAGGAAGCT
 301 AAAATGGAGA AAAAAATCAC TGGATATACC ACCGTTGATA TATCCCAATG GCATCGTAAA
 361 GAACATTTTG AGGCATTTCA GTCAGTTGCT CAATGTACCT ATAACCAGAC CGTTCAGCTG
 421 GATATTACGG CCTTTTTAAA GACCGTAAAG AAAAATAAGC ACAAGTTTTA TCCGGCCTTT
 481 ATTCACATTC TTGCCCGCCT GATGAATGCT CATCCGGAAT TCCGTATGGC AATGAAAGAC
 541 GGTGAGCTGG TGATATGGGA TAGTGTTCAC CCTTGTTACA CCGTTTTCCA TGAGCAAACT
 601 GAAACGTTTT CATCGCTCTG GAGTGAATAC CACGACGATT TCCGGCAGTT TCTACACATA
 661 TATTCGCAAG ATGTGGCGTG TTACGGTGAA AACCTGGCCT ATTTCCCTAA AGGGTTTATT
 721 GAGAATATGT TTTTCGTCTC AGCCAATCCC TGGGTGAGTT TCACCAGTTT TGATTTAAAC
 781 GTGGCCAATA TGGACAACTT CTTCGCCCCC GTTTTCACCA TGGGCAAATA TTATACGCAA
 841 GGCGACAAGG TGCTGATGCC GCTGGCGATT CAGGTTCATC ATGCCGTCTG TGATGGCTTC
 901 CATGTCGGCA GAATGCTTAA TGAATTACAA CAGTACTGCG ATGAGTGGCA GGGCGGGGCG
 961 TAAACGCGTG GATCCGGCTT ACTAAAAGCC AGATAACAGT ATGCGTATTT GCGCGCTGAT
1021 TTTTGCGGTA TAAGAATATA TACTGATATG TATACCCGAA GTATGTCAAA AAGAGGTGTG
1081 CTATGAAGCA GCGTATTACA GTGACAGTTG ACAGCGACAG CTATCAGTTG CTCAAGGCAT
1141 ATATGATGTC AATATCTCCG GTCTGGTAAG CACAACCATG CAGAATGAAG CCCGTCGTCT
1201 GCGTGCCGAA CGCTGGAAAG CGGAAAATCA GGAAGGGATG GCTGAGGTCG CCCGGTTTAT
1261 TGAAATGAAC GGCTCTTTTG CTGACGAGAA CAGGGACTGG TGAAATGCAG TTTAAGGTTT
1321 ACACCTATAA AAGAGAGAGC CGTTATCGTC TGTTTGTGGA TGTACAGAGT GATATTATTG
1381 ACACGCCCGG GCGACGGATG GTGATCCCCC TGGCCAGTGC ACGTCTGCTG TCAGATAAAG
1441 TCTCCCGTGA ACTTTACCCG GTGGTGCATA TCGGGGATGA AAGCTGGCGC ATGATGACCA
1501 CCGATATGGC CAGTGTGCCG GTCTCCGTTA TCGGGGAAGA AGTGGCTGAT CTCAGCCACC
1561 GCGAAAATGA CATCAAAAAC GCCATTAACC TGATGTTCTG GGGAATATAA ATGTCAGGCT
1621 CCCTTATACA CAGCCAGTCT GCAGGTCGAC CATAGTGACT GGATATGTTG TGTTTTACAG
1681 TATTATGTAG TCTGTTTTTT ATGCAAAATC TAATTTAATA TATTGATATT TATATCATTT
1741 TACGTTTCTC GTTCAGCTTT CTTGTACAAA GTGGTGATTA TGTCCCCTAT ACTAGGTTAT
1801 TGGAAAATTA AGGGCCTTGT GCAACCCACT CGACTTCTTT TGGAATATCT TGAAGAAAAA
1861 TATGAAGAGC ATTTGTATGA GCGCGATGAA GGTGATAAAT GGCGAAACAA AAAGTTTGAA
1921 TTGGGTTTGG AGTTTCCCAA TCTTCCTTAT TATATTGATG GTGATGTTAA ATTAACACAG
```

FIG.44B

```
1981 TCTATGGCCA TCATACGTTA TATAGCTGAC AAGCACAACA TGTTGGGTGG TTGTCCAAAA
2041 GAGCGTGCAG AGATTTCAAT GCTTGAAGGA GCGGTTTTGG ATATTAGATA CGGTGTTTCG
2101 AGAATTGCAT ATAGTAAAGA CTTTGAAACT CTCAAAGTTG ATTTTCTTAG CAAGCTACCT
2161 GAAATGCTGA AAATGTTCGA AGATCGTTTA TGTCATAAAA CATATTTAAA TGGTGATCAT
2221 GTAACCCATC CTGACTTCAT GTTGTATGAC GCTCTTGATG TTGTTTTATA CATGGACCCA
2281 ATGTGCCTGG ATGCGTTCCC AAAATTAGTT TGTTTTAAAA AACGTATTGA AGCTATCCCA
2341 CAAATTGATA AGTACTTGAA ATCCAGCAAG TATATAGCAT GGCCTTTGCA GGGCTGGCAA
2401 GCCACGTTTG GTGGTGGCGA CCATCCTCCA AAATCGGATC TGGTTCCGCG TCCATGGGGA
2461 TCCGGCTGCT AACAAAGCCC GAAAGGAAGC TGAGTTGGCT GCTGCCACCG CTGAGCAATA
2521 ACTAGCATAA CCCCTTGGGG CCTCTAAACG GGTCTTGAGG GGTTTTTTGC TGAAAGGAGG
2581 AACTATATCC GGATATCCAC AGGACGGGTG TGGTCGCCAT GATCGCGTAG TCGATAGTGG
2641 CTCCAAGTAG CGAAGCGAGC AGGACTGGGC GGCGGCCAAA GCGGTCGGAC AGTGCTCCGA
2701 GAACGGGTGC GCATAGAAAT TGCATCAACG CATATAGCGC TAGCAGCACG CCATAGTGAC
2761 TGGCGATGCT GTCGGAATGG ACGATATCCC GCAAGAGGCC CGGCAGTACC GGCATAACCA
2821 AGCCTATGCC TACAGCATCC AGGGTGACGG TGCCGAGGAT GACGATGAGC GCATTGTTAG
2881 ATTTCATACA CGGTGCCTGA CTGCGTTAGC AATTTAACTG TGATAAACTA CCGCATTAAA
2941 GCTTATCGAT GATAAGCTGT CAAACATGAG AATTCTTGAA GACGAAAGGG CCTCGTGATA
3001 CGCCTATTTT TATAGGTTAA TGTCATGATA ATAATGGTTT CTTAGACGTC AGGTGGCACT
3061 TTTCGGGGAA ATGTGCGCGG AACCCCTATT TGTTTATTTT TCTAAATACA TTCAAATATG
3121 TATCCGCTCA TGAGACAATA ACCCTGATAA ATGCTTCAAT AATATTGAAA AAGGAAGAGT
3181 ATGAGTATTC AACATTTCCG TGTCGCCCTT ATTCCCTTTT TTGCGGCATT TTGCCTTCCT
3241 GTTTTTGCTC ACCCAGAAAC GCTGGTGAAA GTAAAAGATG CTGAAGATCA GTTGGGTGCA
3301 CGAGTGGGTT ACATCGAACT GGATCTCAAC AGCGGTAAGA TCCTTGAGAG TTTTCGCCCC
3361 GAAGAACGTT TTCCAATGAT GAGCACTTTT AAAGTTCTGC TATGTGGCGC GGTATTATCC
3421 CGTGTTGACG CCGGGCAAGA GCAACTCGGT CGCCGCATAC ACTATTCTCA GAATGACTTG
3481 GTTGAGTACT CACCAGTCAC AGAAAAGCAT CTTACGGATG GCATGACAGT AAGAGAATTA
3541 TGCAGTGCTG CCATAACCAT GAGTGATAAC ACTGCGGCCA ACTTACTTCT GACAACGATC
3601 GGAGGACCGA AGGAGCTAAC CGCTTTTTTG CACAACATGG GGGATCATGT AACTCGCCTT
3661 GATCGTTGGG AACCGGAGCT GAATGAAGCC ATACCAAACG ACGAGCGTGA CACCACGATG
3721 CCTGCAGCAA TGGCAACAAC GTTGCGCAAA CTATTAACTG GCGAACTACT TACTCTAGCT
3781 TCCCGGCAAC AATTAATAGA CTGGATGGAG GCGGATAAAG TTGCAGGACC ACTTCTGCGC
3841 TCGGCCCTTC CGGCTGGCTG GTTTATTGCT GATAAATCTG GAGCCGGTGA GCGTGGGTCT
3901 CGCGGTATCA TTGCAGCACT GGGGCCAGAT GGTAAGCCCT CCCGTATCGT AGTTATCTAC
3961 ACGACGGGGA GTCAGGCAAC TATGGATGAA CGAAATAGAC AGATCGCTGA GATAGGTGCC
4021 TCACTGATTA AGCATTGGTA ACTGTCAGAC CAAGTTTACT CATATATACT TTAGATTGAT
4081 TTAAAACTTC ATTTTTAATT TAAAAGGATC TAGGTGAAGA TCCTTTTTGA TAATCTCATG
4141 ACCAAAATCC CTTAACGTGA GTTTTCGTTC CACTGAGCGT CAGACCCCGT AGAAAAGATC
4201 AAAGGATCTT CTTGAGATCC TTTTTTTCTG CGCGTAATCT GCTGCTTGCA AACAAAAAAA
4261 CCACCGCTAC CAGCGGTGGT TTGTTTGCCG GATCAAGAGC TACCAACTCT TTTTCCGAAG
4321 GTAACTGGCT TCAGCAGAGC GCAGATACCA AATACTGTCC TTCTAGTGTA GCCGTAGTTA
4381 GGCCACCACT TCAAGAACTC TGTAGCACCG CCTACATACC TCGCTCTGCT AATCCTGTTA
4441 CCAGTGGCTG CTGCCAGTGG CGATAAGTCG TGTCTTACCG GGTTGGACTC AAGACGATAG
4501 TTACCGGATA AGGCGCAGCG GTCGGGCTGA ACGGGGGGTT CGTGCACACA GCCCAGCTTG
4561 GAGCGAACGA CCTACACCGA ACTGAGATAC CTACAGCGTG AGCTATGAGA AAGCGCCACG
4621 CTTCCCGAAG GGAGAAAGGC GGACAGGTAT CCGGTAAGCG GCAGGGTCGG AACAGGAGAG
4681 CGCACGAGGG AGCTTCCAGG GGGAAACGCC TGGTATCTTT ATAGTCCTGT CGGGTTTCGC
```

FIG.44C

```
4741 CACCTCTGAC TTGAGCGTCG ATTTTTGTGA TGCTCGTCAG GGGGGCGGAG CCTATGGAAA
4801 AACGCCAGCA ACGCGGCCTT TTTACGGTTC CTGGCCTTTT GCTGGCCTTT TGCTCACATG
4861 TTCTTTCCTG CGTTATCCCC TGATTCTGTG GATAACCGTA TTACCGCCTT TGAGTGAGCT
4921 GATACCGCTC GCCGCAGCCG AACGACCGAG CGCAGCGAGT CAGTGAGCGA GGAAGCGGAA
4981 GAGCGCCTGA TGCGGTATTT TCTCCTTACG CATCTGTGCG GTATTTCACA CCGCATATAT
5041 GGTGCACTCT CAGTACAATC TGCTCTGATG CCGCATAGTT AAGCCAGTAT ACACTCCGCT
5101 ATCGCTACGT GACTGGGTCA TGGCTGCGCC CCGACACCCG CCAACACCCG CTGACGCGCC
5161 CTGACGGGCT TGTCTGCTCC CGGCATCCGC TTACAGACAA GCTGTGACCG TCTCCGGGAG
5221 CTGCATGTGT CAGAGGTTTT CACCGTCATC ACCGAAACGC GCGAGGCAGC TGCGGTAAAG
5281 CTCATCAGCG TGGTCGTGAA GCGATTCACA GATGTCTGCC TGTTCATCCG CGTCCAGCTC
5341 GTTGAGTTTC TCCAGAAGCG TTAATGTCTG GCTTCTGATA AAGCGGGCCA TGTTAAGGGC
5401 GGTTTTTTCC TGTTTGGTCA CTGATGCCTC CGTGTAAGGG GGATTTCTGT TCATGGGGGT
5461 AATGATACCG ATGAAACGAG AGAGGATGCT CACGATACGG GTTACTGATG ATGAACATGC
5521 CCGGTTACTG GAACGTTGTG AGGGTAAACA ACTGGCGGTA TGGATGCGGC GGGACCAGAG
5581 AAAAATCACT CAGGGTCAAT GCCAGCGCTT CGTTAATACA GATGTAGGTG TTCCACAGGG
5641 TAGCCAGCAG CATCCTGCGA TGCAGATCCG GAACATAATG GTGCAGGGCG CTGACTTCCG
5701 CGTTTCCAGA CTTTACGAAA CACGGAAACC GAAGACCATT CATGTTGTTG CTCAGGTCGC
5761 AGACGTTTTG CAGCAGCAGT CGCTTCACGT TCGCTCGCGT ATCGGTGATT CATTCTGCTA
5821 ACCAGTAAGG CAACCCCGCC AGCCTAGCCG GGTCCTCAAC GACAGGAGCA CGATCATGCG
5881 CACCCGTGGC CAGGACCCAA CGCTGCCCGA GATGCGCCGC GTGCGGCTGC TGGAGATGGC
5941 GGACGCGATG GATATGTTCT GCCAAGGGTT GGTTTGCGCA TTCACAGTTC TCCGCAAGAA
6001 TTGATTGGCT CCAATTCTTG GAGTGGTGAA TCCGTTAGCG AGGTGCCGCC GGCTTCCATT
6061 CAGGTCGAGG TGGCCCGGCT CCATGCACCG CGACGCAACG CGGGGAGGCA GACAAGGTAT
6121 AGGGCGGCGC CTACAATCCA TGCCAACCCG TTCCATGTGC TCGCCGAGGC GGCATAAATC
6181 GCCGTGACGA TCAGCGGTCC AGTGATCGAA GTTAGGCTGG TAAGAGCCGC GAGCGATCCT
6241 TGAAGCTGTC CCTGATGGTC GTCATCTACC TGCCTGGACA GCATGGCCTG CAACGCGGGC
6301 ATCCCGATGC CGCCGGAAGC GAGAAGAATC ATAATGGGGA AGGCCATCCA GCCTCGCGTC
6361 GCGAACGCCA GCAAGACGTA GCCCAGCGCG TCGGCCGCCA TGCCGGCGAT AATGGCCTGC
6421 TTCTCGCCGA AACGTTTGGT GGCGGGACCA GTGACGAAGG CTTGAGCGAG GGCGTGCAAG
6481 ATTCCGAATA CCGCAAGCGA CAGGCCGATC ATCGTCGCGC TCCAGCGAAA GCGGTCCTCG
6541 CCGAAAATGA CCCAGAGCGC TGCCGGCACC TGTCCTACGA GTTGCATGAT AAAGAAGACA
6601 GTCATAAGTG CGGCGACGAT AGTCATGCCC CGCGCCCACC GGAAGGAGCT GACTGGGTTG
6661 AAGGCTCTCA AGGGCATCGG TCGATCGACG CTCTCCCTTA TGCGACTCCT GCATTAGGAA
6721 GCAGCCCAGT AGTAGGTTGA GGCCGTTGAG CACCGCCGCC GCAAGGAATG GTGCATGCAA
6781 GGAGATGGCG CCCAACAGTC CCCCGGCCAC GGGGCCTGCC ACCATACCCA CGCCGAAACA
6841 AGCGCTCATG AGCCCGAAGT GGCGAGCCCG ATCTTCCCCA TCGGTGATGT CGGCGATATA
6901 GGCGCCAGCA ACCGCACCTG TGGCGCCGGT GATGCCGGCC ACGATGCGTC CGGCGTAGAG
6961 G
```

FIG.44D pDEST25
THIOREDOXIN CARBOXY-FUSION VECTOR, T7 PROMOTER

```
                                    T7 PROMOTER         ┌─── mRNA
 1  nag atc tcg atc ccg cga aat │taa tac gac tca cta tag gg│a gac cac aac
    ntc tag agc tag ggc gct tta │att atg ctg agt gat atc cc│t ctg gtg ttg
                                         Int                        attR1
52  ggt ttc cct cta gat c│ac aag ttt│gta caa aaa agc tga acg aga aac gta'
    cca aag gga gat cta g│cg ttc aaa cat gtt t│tt tcg act tgc tct ttg cat,
    ╰─────── CmR ──────────── ccdB ─────────╯
                                        Int
           attR2           —  A   F   L   Y   K   V   V   I   M   S   D
1735 'ttt tac gtt tct cgt tca gct t│c ttg tac aaa gtg gt│g att atg agc gat
    ,aaa atg caa aga gca agt cga ag│c atg│ttt cac cac tac tcg cta
             K   I   I  ──── Trx PROTEIN   (~130 aa.) ────▶
1786 aaa att att cac ctg act gac gac agt ttt gac acg gat gta ctc aaa gcg
     ttt taa taa gtg gac tga ctg ctg tca aaa ctg tgc cta cat gag ttt cgc
```

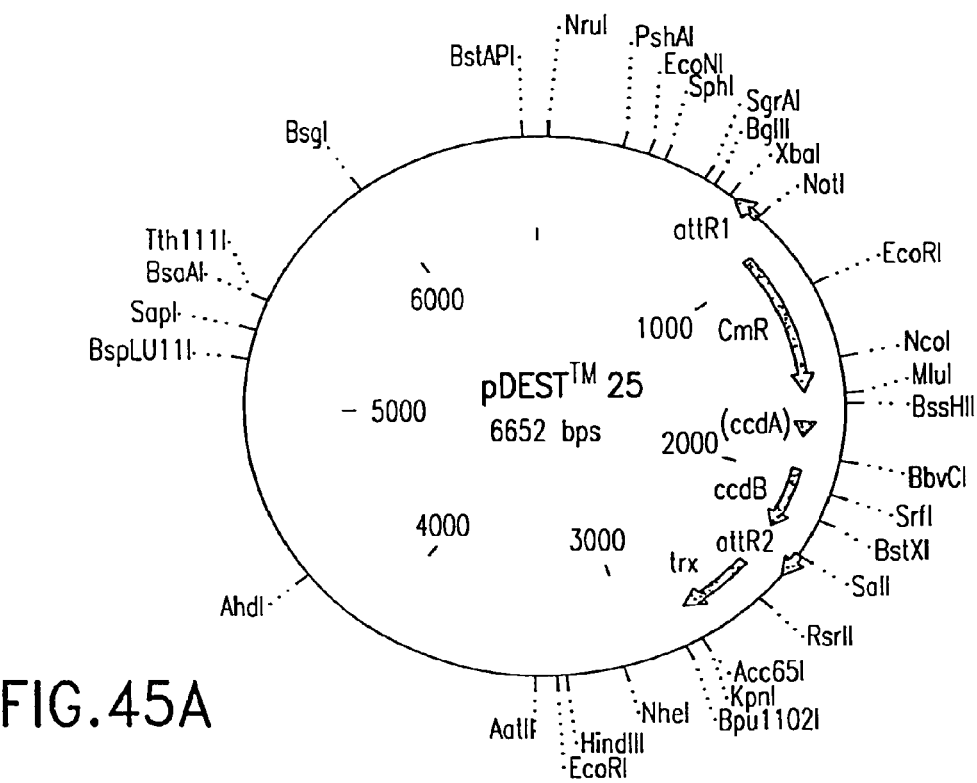

FIG.45A pDEST25 6652 bp

| Location (Base Nos.) | Gene Encoded |
|---|---|
| 844..720 | attR1 |
| 953..1612 | CmR |
| 1732..1816 | inactivated ccdA |
| 1954..2259 | ccdB |
| 2300..2424 | attR2 |
| 2432..2794 | trx |

```
   1 CCGGAAGCGA GAAGAATCAT AATGGGGAAG GCCATCCAGC CTCGCGTCGC GAACGCCAGC
  61 AAGACGTAGC CCAGCGCGTC GGCCGCCATG CCGGCGATAA TGGCCTGCTT CTCGCCGAAA
 121 CGTTTGGTGG CGGGACCAGT GACGAAGGCT TGAGCGAGGG CGTGCAAGAT TCCGAATACC
 181 GCAAGCGACA GGCCGATCAT CGTCGCGCTC CAGCGAAAGC GGTCCTCGCC GAAAATGACC
 241 CAGAGCGCTG CCGGCACCTG TCCTACGAGT TGCATGATAA AGAAGACAGT CATAAGTGCG
 301 GCGACGATAG TCATGCCCCG CGCCCACCGG AAGGAGCTGA CTGGGTTGAA GGCTCTCAAG
 361 GGCATCGGTC GATCGACGCT CTCCCTTATG CGACTCCTGC ATTAGGAAGC AGCCCAGTAG
 421 TAGGTTGAGG CCGTTGAGCA CCGCCGCCGC AAGGAATGGT GCATGCAAGG AGATGGCGCC
 481 CAACAGTCCC CCGGCCACGG GGCCTGCCAC CATACCCACG CCGAAACAAG CGCTCATGAG
 541 CCCGAAGTGG CGAGCCCGAT CTTCCCCATC GGTGATGTCG GCGATATAGG CGCCAGCAAC
 601 CGCACCTGTG GCGCCGGTGA TGCCGGCCAC GATGCGTCCG GCGTAGAGGA TCGAGATCTC
 661 GATCCCGCGA AATTAATACG ACTCACTATA GGGAGACCAC AACGGTTTCC CTCTAGATCA
 721 CAAGTTTGTA CAAAAAAGCT GAACGAGAAA CGTAAAATGA TATAAATATC AATATATTAA
 781 ATTAGATTTT GCATAAAAAA CAGACTACAT AATACTGTAA AACACAACAT ATCCAGTCAC
 841 TATGGCGGCC GCATTAGGCA CCCCAGGCTT TACACTTTAT GCTTCCGGCT CGTATAATGT
 901 GTGGATTTTG AGTTAGGATC CGGCGAGATT TTCAGGAGCT AAGGAAGCTA AAATGGAGAA
 961 AAAAATCACT GGATATACCA CCGTTGATAT ATCCCAATGG CATCGTAAAG AACATTTTGA
1021 GGCATTTCAG TCAGTTGCTC AATGTACCTA TAACCAGACC GTTCAGCTGG ATATTACGGC
1081 CTTTTTAAAG ACCGTAAAGA AAAATAAGCA CAAGTTTTAT CCGGCCTTTA TTCACATTCT
1141 TGCCCGCCTG ATGAATGCTC ATCCGGAATT CCGTATGGCA ATGAAAGACG GTGAGCTGGT
1201 GATATGGGAT AGTGTTCACC CTTGTTACAC CGTTTTCCAT GAGCAAACTG AAACGTTTTC
1261 ATCGCTCTGG AGTGAATACC ACGACGATTT CCGGCAGTTT CTACACATAT ATTCGCAAGA
1321 TGTGGCGTGT TACGGTGAAA ACCTGGCCTA TTTCCCTAAA GGGTTTATTG AGAATATGTT
1381 TTTCGTCTCA GCCAATCCCT GGGTGAGTTT CACCAGTTTT GATTTAAACG TGGCCAATAT
1441 GGACAACTTC TTCGCCCCCG TTTTCACCAT GGGCAAATAT TATACGCAAG GCGACAAGGT
1501 GCTGATGCCG CTGGCGATTC AGGTTCATCA TGCCGTCTGT GATGGCTTCC ATGTCGGCAG
1561 AATGCTTAAT GAATTACAAC AGTACTGCGA TGAGTGGCAG GGCGGGGCGT AAACGCGTGG
1621 ATCCGGCTTA CTAAAAGCCA GATAACAGTA TGCGTATTTG CGCGCTGATT TTTGCGGTAT
1681 AAGAATATAT ACTGATATGT ATACCCGAAG TATGTCAAAA AGAGGTGTGC TATGAAGCAG
1741 CGTATTACAG TGACAGTTGA CAGCGACAGC TATCAGTTGC TCAAGGCATA TATGATGTCA
1801 ATATCTCCGG TCTGGTAAGC ACAACCATGC AGAATGAAGC CCGTCGTCTG CGTGCCGAAC
1861 GCTGGAAAGC GGAAAATCAG AAGGGATGG CTGAGGTCGC CCGGTTTATT GAAATGAACG
1921 GCTCTTTTGC TGACGAGAAC AGGGACTGGT GAAATGCAGT TTAAGGTTTA CACCTATAAA
1981 AGAGAGAGCC GTTATCGTCT GTTTGTGGAT GTACAGAGTG ATATTATTGA CACGCCCGGG
2041 CGACGGATGG TGATCCCCCT GGCCAGTGCA CGTCTGCTGT CAGATAAAGT CTCCCGTGAA
```

FIG.45B

```
2101 CTTTACCCGG TGGTGCATAT CGGGGATGAA AGCTGGCGCA TGATGACCAC CGATATGGCC
2161 AGTGTGCCGG TCTCCGTTAT CGGGGAAGAA GTGGCTGATC TCAGCCACCG CGAAAATGAC
2221 ATCAAAAACG CCATTAACCT GATGTTCTGG GGAATATAAA TGTCAGGCTC CCTTATACAC
2281 AGCCAGTCTG CAGGTCGACC ATAGTGACTG GATATGTTGT GTTTTACAGT ATTATGTAGT
2341 CTGTTTTTTA TGCAAAATCT AATTTAATAT ATTGATATTT ATATCATTTT ACGTTTCTCG
2401 TTCAGCTTTC TTGTACAAAG TGGTGATTAT GAGCGATAAA ATTATTCACC TGACTGACGA
2461 CAGTTTTGAC ACGGATGTAC TCAAAGCGGA CGGGGCGATC CTCGTCGATT TCTGGGCAGA
2521 GTGGTGCGGT CCGTGCAAAA TGATCGCCCC GATTCTGGAT GAAATCGCTG ACGAATATCA
2581 GGGCAAACTG ACCGTTGCAA AACTGAACAT CGATCAAAAC CTGGCACTG CGCCGAAAATA
2641 TGGCATCCGT GGTATCCCGA CTCTGCTGCT GTTCAAAAAC GGTGAAGTGG CGGCAACCAA
2701 AGTGGGTGCA CTGTCTAAAG GTCAGTTGAA AGAGTTCCTC GACGCTAACC TGGCCGGTTC
2761 TGGTTCTGGT GATGACGATG ACAAGGTACC CGGGGATCGA TCCGGCTGCT AACAAAGCCC
2821 GAAAGGAAGC TGAGTTGGCT GCTGCCACCG CTGAGCAATA ACTAGCATAA CCCCTTGGGG
2881 CCTCTAAACG GGTCTTGAGG GGTTTTTTGC TGAAAGGAGG AACTATATCC GGATATCCAC
2941 AGGACGGGTG TGGTCGCCAT GATCGCGTAG TCGATAGTGG CTCCAAGTAG CGAAGCGAGC
3001 AGGACTGGGC GGCGGCCAAA GCGGTCGGAC AGTGCTCCGA GAACGGGTGC GCATAGAAAT
3061 TGCATCAACG CATATAGCGC TAGCAGCACG CCATAGTGAC TGGCGATGCT GTCGGAATGG
3121 ACGATATCCC GCAAGAGGCC CGGCAGTACC GGCATAACCA AGCCTATGCC TACAGCATCC
3181 AGGGTGACGG TGCCGAGGAT GACGATGAGC GCATTGTTAG ATTTCATACA CGGTGCCTGA
3241 CTGCGTTAGC AATTTAACTG TGATAAACTA CCGCATTAAA GCTTATCGAT GATAAGCTGT
3301 CAAACATGAG AATTCTTGAA GACGAAAGGG CCTCGTGATA CGCCTATTTT TATAGGTTAA
3361 TGTCATGATA ATAATGGTTT CTTAGACGTC AGGTGGCACT TTTCGGGGAA ATGTGCGCGG
3421 AACCCCTATT TGTTTATTTT TCTAAATACA TTCAAATATG TATCCGCTCA TGAGACAATA
3481 ACCCTGATAA ATGCTTCAAT AATATTGAAA AAGGAAGAGT ATGAGTATTC AACATTTCCG
3541 TGTCGCCCTT ATTCCCTTTT TTGCGGCATT TTGCCTTCCT GTTTTTGCTC ACCCAGAAAC
3601 GCTGGTGAAA GTAAAAGATG CTGAAGATCA GTTGGGTGCA CGAGTGGGTT ACATCGAACT
3661 GGATCTCAAC AGCGGTAAGA TCCTTGAGAG TTTTCGCCCC GAAGAACGTT TTCCAATGAT
3721 GAGCACTTTT AAAGTTCTGC TATGTGGCGC GGTATTATCC CGTGTTGACG CCGGGCAAGA
3781 GCAACTCGGT CGCCGCATAC ACTATTCTCA GAATGACTTG GTTGAGTACT CACCAGTCAC
3841 AGAAAAGCAT CTTACGGATG GCATGACAGT AAGAGAATTA TGCAGTGCTG CCATAACCAT
3901 GAGTGATAAC ACTGCGGCCA ACTTACTTCT GACAACGATC GGAGGACCGA AGGAGCTAAC
3961 CGCTTTTTTG CACAACATGG GGGATCATGT AACTCGCCTT GATCGTTGGG AACCGGAGCT
4021 GAATGAAGCC ATACCAAACG ACGAGCGTGA CACCACGATG CCTGCAGCAA TGGCAACAAC
4081 GTTGCGCAAA CTATTAACTG GCGAACTACT TACTCTAGCT TCCCGGCAAC AATTAATAGA
4141 CTGGATGGAG GCGGATAAAG TTGCAGGACC ACTTCTGCGC TCGGCCCTTC CGGCTGGCTG
4201 GTTTATTGCT GATAAATCTG GAGCCGGTGA GCGTGGGTCT CGCGGTATCA TTGCAGCACT
4261 GGGGCCAGAT GGTAAGCCCT CCCGTATCGT AGTTATCTAC ACGACGGGGA GTCAGGCAAC
4321 TATGGATGAA CGAAATAGAC AGATCGCTGA GATAGGTGCC TCACTGATTA AGCATTGGTA
4381 ACTGTCAGAC CAAGTTTACT CATATATACT TTAGATTGAT TTAAAACTTC ATTTTTAATT
4441 TAAAAGGATC TAGGTGAAGA TCCTTTTTGA TAATCTCATG ACCAAAATCC CTTAACGTGA
4501 GTTTTCGTTC CACTGAGCGT CAGACCCCGT AGAAAAGATC AAAGGATCTT CTTGAGATCC
4561 TTTTTTTCTG CGCGTAATCT GCTGCTTGCA AACAAAAAAA CCACCGCTAC CAGCGGTGGT
4621 TTGTTTGCCG GATCAAGAGC TACCAACTCT TTTTCCGAAG GTAACTGGCT TCAGCAGAGC
4681 GCAGATACCA AATACTGTCC TTCTAGTGTA GCCGTAGTTA GGCCACCACT TCAAGAACTC
4741 TGTAGCACCG CCTACATACC TCGCTCTGCT AATCCTGTTA CCAGTGGCTG CTGCCAGTGG
4801 CGATAAGTCG TGTCTTACCG GGTTGGACTC AAGACGATAG TTACCGGATA AGGCGCAGCG
```

FIG.45C

```
4861 GTCGGGCTGA ACGGGGGGTT CGTGCACACA GCCCAGCTTG GAGCGAACGA CCTACACCGA
4921 ACTGAGATAC CTACAGCGTG AGCTATGAGA AAGCGCCACG CTTCCCGAAG GGAGAAAGGC
4981 GGACAGGTAT CCGGTAAGCG GCAGGGTCGG AACAGGAGAG CGCACGAGGG AGCTTCCAGG
5041 GGGAAACGCC TGGTATCTTT ATAGTCCTGT CGGGTTTCGC CACCTCTGAC TTGAGCGTCG
5101 ATTTTTGTGA TGCTCGTCAG GGGGGCGGAG CCTATGGAAA AACGCCAGCA ACGCGGCCTT
5161 TTTACGGTTC CTGGCCTTTT GCTGGCCTTT TGCTCACATG TTCTTTCCTG CGTTATCCCC
5221 TGATTCTGTG GATAACCGTA TTACCGCCTT TGAGTGAGCT GATACCGCTC GCCGCAGCCG
5281 AACGACCGAG CGCAGCGAGT CAGTGAGCGA GGAAGCGGAA GAGCGCCTGA TGCGGTATTT
5341 TCTCCTTACG CATCTGTGCG GTATTTCACA CCGCATATAT GGTGCACTCT CAGTACAATC
5401 TGCTCTGATG CCGCATAGTT AAGCCAGTAT ACACTCCGCT ATCGCTACGT GACTGGGTCA
5461 TGGCTGCGCC CCGACACCCG CCAACACCCG CTGACGCGCC CTGACGGGCT TGTCTGCTCC
5521 CGGCATCCGC TTACAGACAA GCTGTGACCG TCTCCGGGAG CTGCATGTGT CAGAGGTTTT
5581 CACCGTCATC ACCGAAACGC GCGAGGCAGC TGCGGTAAAG CTCATCAGCG TGGTCGTGAA
5641 GCGATTCACA GATGTCTGCC TGTTCATCCG CGTCCAGCTC GTTGAGTTTC TCCAGAAGCG
5701 TTAATGTCTG GCTTCTGATA AAGCGGGCCA TGTTAAGGGC GGTTTTTTCC TGTTTGGTCA
5761 CTGATGCCTC CGTGTAAGGG GGATTTCTGT TCATGGGGGT AATGATACCG ATGAAACGAG
5821 AGAGGATGCT CACGATACGG GTTACTGATG ATGAACATGC CCGGTTACTG GAACGTTGTG
5881 AGGGTAAACA ACTGGCGGTA TGGATGCGGC GGGACCAGAG AAAAATCACT CAGGGTCAAT
5941 GCCAGCGCTT CGTTAATACA GATGTAGGTG TTCCACAGGG TAGCCAGCAG CATCCTGCGA
6001 TGCAGATCCG GAACATAATG GTGCAGGGCG CTGACTTCCG CGTTTCCAGA CTTTACGAAA
6061 CACGGAAACC GAAGACCATT CATGTTGTTG CTCAGGTCGC AGACGTTTTG CAGCAGCAGT
6121 CGCTTCACGT TCGCTCGCGT ATCGGTGATT CATTCTGCTA ACCAGTAAGG CAACCCCGCC
6181 AGCCTAGCCG GTCCTCAAC GACAGGAGCA CGATCATGCG CACCCGTGGC CAGGACCCAA
6241 CGCTGCCCGA GATGCGCCGC GTGCGGCTGC TGGAGATGGC GGACGCGATG GATATGTTCT
6301 GCCAAGGGTT GGTTTGCGCA TTCACAGTTC TCCGCAAGAA TTGATTGGCT CCAATTCTTG
6361 GAGTGGTGAA TCCGTTAGCG AGGTGCCGCC GGCTTCCATT CAGGTCGAGG TGGCCCGGCT
6421 CCATGCACCG CGACGCAACG CGGGGAGGCA GACAAGGTAT AGGGCGGCGC CTACAATCCA
6481 TGCCAACCCG TTCCATGTGC TCGCCGAGGC GGCATAAATC GCCGTGACGA TCAGCGGTCC
6541 AGTGATCGAA GTTAGGCTGG TAAGAGCCGC GAGCGATCCT TGAAGCTGTC CCTGATGGTC
6601 GTCATCTACC TGCCTGGACA GCATGGCCTG CAACGCGGGC ATCCCGATGC CG
```

FIG.45D pDEST26 His6 AMINO FUSION IN pCMV Sport-neo VECTOR

```
600 ttg acg tca atg gga gtt tgt ttt ggc acc aaa ctc aac ggg act ttc caa
    aac tgc agt tac cct caa aca aaa ccg tgg ttt aag ttg ccc tga aag gtt 651 aat gtc gta aca act ccg ccc cat tga cgc aaa tgg gcg gta ggc gtg tac
    tta cag cat tgt tga ggc ggg gta act gcg ttt acc cgc cat ccg cac atg
```

CMV promoter                    ┌── mRNA start
```
702 ggt ggg agg tct ata taa gca gag ctc gtt tag tga acc g│tc│aga tcg cct
    cca ccc tcc aga tat att cgt ctc gag caa atc act tgg c│ag│tct agc gga
```

```
753 gga gac gcc atc cac gct gtt ttg acc tcc ata gaa gac acc ggg acc gat
    cct ctg cgg tag gtg cga caa aac tgg agg tat ctt ctg tgg ccc tgg cta
```

Start Translation  ┌─ M   A   Y   Y   H   H
```
804 cca gcc tcc gga ctc tag cct agg ccg cgg acc│atg gcg tac tac cat cac
    ggt cgg agg cct gag atc gga tcc ggc gcc tgg│tac cgc atg atg gta gtg
```

H   H   H   H   S   R   S  ┌T   S   L   Y   K   K   A    attR1
```
855 cat cac cat cac tct aga tca│aca agt ttg tac aaa aaa gct gaa cga gaa
    gta gtg gta gtg aga tct agt│tgt tca aac atg ttt ttt cga ctt gct ctt
                                                                  Int
```

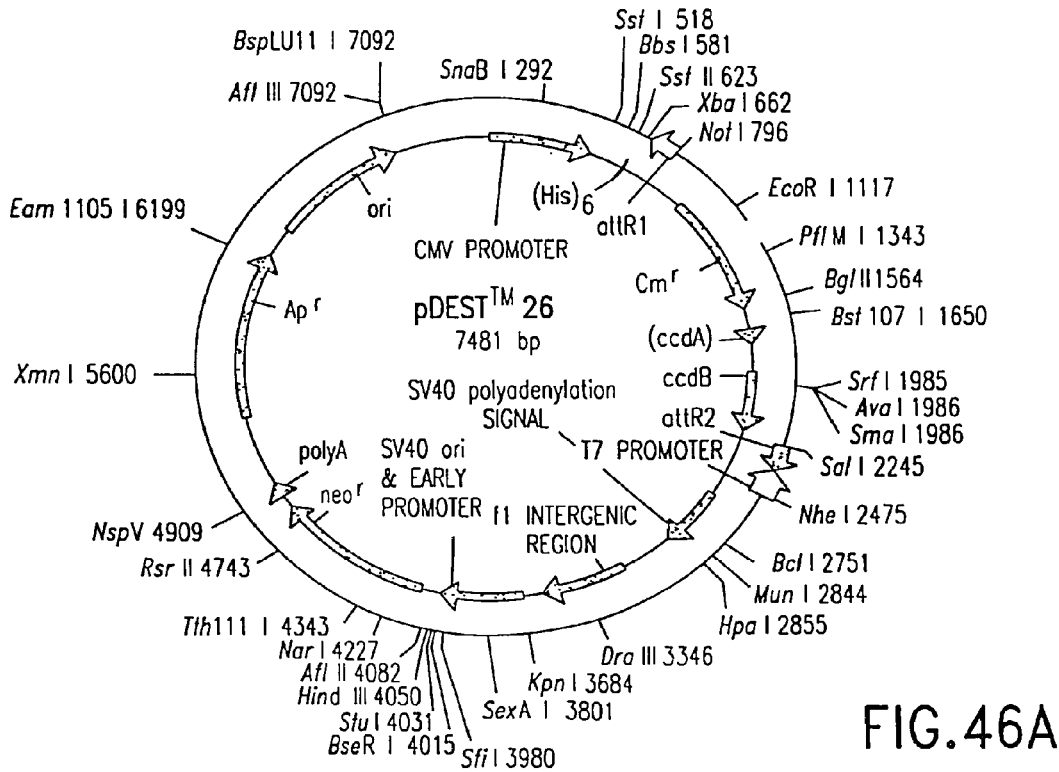

FIG.46A pDEST26 7481 bp

| Location (Base Nos.) | Gene Encoded |
|---|---|
| 492..509 | his6 |
| 619..519 | attR1 |
| 752..1411 | CmR |
| 1531..1615 | inactivated ccdA |
| 1753..2058 | ccdB |
| 2099..2223 | attR2 |
| 2409..2771 | SV40 polyA |
| 2966..3421 | f1 intergenic region |
| 3485..3903 | SV40 promoter |
| 3948..4742 | neo |
| 4806..4854 | polyA |
| 5265..6125 | Apr |
| 6274..6913 | ori |
| 7344..385 | CMV promoter |

```
   1 GTAAACTGCC CACTTGGCAG TACATCAAGT GTATCATATG CCAAGTACGC CCCCTATTGA
  61 CGTCAATGAC GGTAAATGGC CCGCCTGGCA TTATGCCCAG TACATGACCT TATGGGACTT
 121 TCCTACTTGG CAGTACATCT ACGTATTAGT CATCGCTATT ACCATGGTGA TGCGGTTTTG
 181 GCAGTACATC AATGGGCGTG GATAGCGGTT TGACTCACGG GGATTTCCAA GTCTCCACCC
 241 CATTGACGTC AATGGGAGTT TGTTTTGGCA CCAAAATCAA CGGGACTTTC CAAAATGTCG
 301 TAACAACTCC GCCCCATTGA CGCAAATGGG CGGTAGGCGT GTACGGTGGG AGGTCTATAT
 361 AAGCAGAGCT CGTTTAGTGA ACCGTCAGAT CGCCTGGAGA CGCCATCCAC GCTGTTTTGA
 421 CCTCCATAGA AGACACCGGG ACCGATCCAG CCTCCGGACT CTAGCCTAGG CCGCGGACCA
 481 TGGCGTACTA CCATCACCAT CACCATCACT CTAGATCAAC AAGTTTGTAC AAAAAAGCTG
 541 AACGAGAAAC GTAAAATGAT ATAAATATCA ATATATTAAA TTAGATTTTG CATAAAAAAC
 601 AGACTACATA ATACTGTAAA ACACAACATA TCCAGTCACT ATGGCGGCCG CATTAGGCAC
 661 CCCAGGCTTT ACACTTTATG CTTCCGGCTC GTATAATGTG TGGATTTTGA GTTAGGATCC
 721 GGCGAGATTT TCAGGAGCTA AGGAAGCTAA AATGGAGAAA AAAATCACTG GATATACCAC
 781 CGTTGATATA TCCCAATGGC ATCGTAAAGA ACATTTTGAG GCATTTCAGT CAGTTGCTCA
 841 ATGTACCTAT AACCAGACCG TTCAGCTGGA TATTACGGCC TTTTTAAAGA CCGTAAAGAA
 901 AAATAAGCAC AAGTTTTATC CGGCCTTTAT TCACATTCTT GCCCGCCTGA TGAATGCTCA
 961 TCCGGAATTC CGTATGGCAA TGAAAGACGG TGAGCTGGTG ATATGGGATA GTGTTCACCC
1021 TTGTTACACC GTTTTCCATG AGCAAACTGA AACGTTTTCA TCGCTCTGGA GTGAATACCA
1081 CGACGATTTC CGGCAGTTTC TACACATATA TTCGCAAGAT GTGGCGTGTT ACGGTGAAAA
1141 CCTGGCCTAT TTCCCTAAAG GGTTTATTGA GAATATGTTT TTCGTCTCAG CCAATCCCTG
1201 GGTGAGTTTC ACCAGTTTTG ATTTAAACGT GGCCAATATG GACAACTTCT TCGCCCCCGT
1261 TTTCACCATG GGCAAATATT ATACGCAAGG CGACAAGGTG CTGATGCCGC TGGCGATTCA
1321 GGTTCATCAT GCCGTCTGTG ATGGCTTCCA TGTCGGCAGA ATGCTTAATG AATTACAACA
1381 GTACTGCGAT GAGTGGCAGG CGGGGCGTA AAGATCTGGA TCCGGCTTAC TAAAAGCCAG
1441 ATAACAGTAT GCGTATTTGC GCGCTGATTT TTGCGGTATA AGAATATATA CTGATATGTA
1501 TACCCGAAGT ATGTCAAAAA GAGGTGTGCT ATGAAGCAGC GTATTACAGT GACAGTTGAC
1561 AGCGACAGCT ATCAGTTGCT CAAGGCATAT ATGATGTCAA TATCTCCGGT CTGGTAAGCA
```

FIG.46B

```
1621 CAACCATGCA GAATGAAGCC CGTCGTCTGC GTGCCGAACG CTGGAAAGCG GAAAATCAGG
1681 AAGGGATGGC TGAGGTCGCC CGGTTTATTG AAATGAACGG CTCTTTTGCT GACGAGAACA
1741 GGGACTGGTG AAATGCAGTT TAAGGTTTAC ACCTATAAAA GAGAGAGCCG TTATCGTCTG
1801 TTTGTGGATG TACAGAGTGA TATTATTGAC ACGCCGGGC GACGGATGGT GATCCCCCTG
1861 GCCAGTGCAC GTCTGCTGTC AGATAAAGTC TCCCGTGAAC TTTACCCGGT GGTGCATATC
1921 GGGGATGAAA GCTGGCGCAT GATGACCACC GATATGGCCA GTGTGCCGGT CTCCGTTATC
1981 GGGGAAGAAG TGGCTGATCT CAGCCACCGC GAAAATGACA TCAAAAACGC CATTAACCTG
2041 ATGTTCTGGG GAATATAAAT GTCAGGCTCC CTTATACACA GCCAGTCTGC AGGTCGACCA
2101 TAGTGACTGG ATATGTTGTG TTTTACAGTA TTATGTAGTC TGTTTTTTAT GCAAAATCTA
2161 ATTTAATATA TTGATATTTA TATCATTTTA CGTTTCTCGT TCAGCTTTCT TGTACAAAGT
2221 GGTTGATCGC GTGCATGCGA CGTCATAGCT CTCTCCCTAT AGTGAGTCGT ATTATAAGCT
2281 AGGCACTGGC CGTCGTTTTA CAACGTCGTG ACTGGGAAAA CTGCTAGCTT GGGATCTTTG
2341 TGAAGGAACC TTACTTCTGT GGTGTGACAT AATTGGACAA ACTACCTACA GAGATTTAAA
2401 GCTCTAAGGT AAATATAAAA TTTTTAAGTG TATAATGTGT TAAACTAGCT GCATATGCTT
2461 GCTGCTTGAG AGTTTTGCTT ACTGAGTATG ATTTATGAAA ATATTATACA CAGGAGCTAG
2521 TGATTCTAAT TGTTTGTGTA TTTTAGATTC ACAGTCCCAA GGCTCATTTC AGGCCCCTCA
2581 GTCCTCACAG TCTGTTCATG ATCATAATCA GCCATACCAC ATTTGTAGAG GTTTTACTTG
2641 CTTTAAAAAA CCTCCCACAC CTCCCCCTGA ACCTGAAACA TAAAATGAAT GCAATTGTTG
2701 TTGTTAACTT GTTTATTGCA GCTTATAATG GTTACAAATA AAGCAATAGC ATCACAAATT
2761 TCACAAATAA AGCATTTTTT TCACTGCATT CTAGTTGTGG TTTGTCCAAA CTCATCAATG
2821 TATCTTATCA TGTCTGGATC GATCCTGCAT TAATGAATCG GCCAACGCGC GGGGAGAGGC
2881 GGTTTGCGTA TTGGCTGGCG TAATAGCGAA GAGGCCCGCA CCGATCGCCC TTCCCAACAG
2941 TTGCGCAGCC TGAATGGCGA ATGGGACGCG CCCTGTAGCG GCGCATTAAG CGCGGCGGGT
3001 GTGGTGGTTA CGCGCAGCGT GACCGCTACA CTTGCCAGCG CCCTAGCGCC CGCTCCTTTC
3061 GCTTTCTTCC CTTCCTTTCT CGCCACGTTC GCCGGCTTTC CCCGTCAAGC TCTAAATCGG
3121 GGGCTCCCTT TAGGGTTCCG ATTTAGTGCT TTACGGCACC TCGACCCCAA AAAACTTGAT
3181 TAGGGTGATG GTTCACGTAG TGGGCCATCG CCCTGATAGA CGGTTTTTCG CCCTTTGACG
3241 TTGGAGTCCA CGTTCTTTAA TAGTGGACTC TTGTTCCAAA CTGGAACAAC ACTCAACCCT
3301 ATCTCGGTCT ATTCTTTTGA TTTATAAGGG ATTTTGCCGA TTTCGGCCTA TTGGTTAAAA
3361 AATGAGCTGA TTTAACAAAT ATTTAACGCG AATTTTAACA AAATATTAAC GTTTACAATT
3421 TCGCCTGATG CGGTATTTTC TCCTTACGCA TCTGTGCGGT ATTTCACACC GCATACGCGG
3481 ATCTGCGCAG CACCATGGCC TGAAATAACC TCTGAAAGAG GAACTTGGTT AGGTACCTTC
3541 TGAGGCGGAA AGAACCAGCT GTGGAATGTG TGTCAGTTAG GGTGTGGAAA GTCCCCAGGC
3601 TCCCCAGCAG GCAGAAGTAT GCAAAGCATG CATCTCAATT AGTCAGCAAC CAGGTGTGGA
3661 AAGTCCCCAG GCTCCCCAGC AGGCAGAAGT ATGCAAAGCA TGCATCTCAA TTAGTCAGCA
3721 ACCATAGTCC CGCCCCTAAC TCCGCCCATC CCGCCCCTAA CTCCGCCCAG TTCCGCCCAT
3781 TCTCCGCCCC ATGGCTGACT AATTTTTTTT ATTTATGCAG AGGCCGAGGC CGCCTCGGCC
3841 TCTGAGCTAT TCCAGAAGTA GTGAGGAGGC TTTTTTGGAG GCCTAGGCTT TTGCAAAAAG
3901 CTTGATTCTT CTGACACAAC AGTCTCGAAC TTAAGGCTAG AGCCACCATG ATTGAACAAG
3961 ATGGATTGCA CGCAGGTTCT CCGGCCGCTT GGGTGGAGAG GCTATTCGGC TATGACTGGG
4021 CACAACAGAC AATCGGCTGC TCTGATGCCG CCGTGTTCCG GCTGTCAGCG CAGGGGCGCC
4081 CGGTTCTTTT TGTCAAGACC GACCTGTCCG GTGCCCTGAA TGAACTGCAG GACGAGGCAG
4141 CGCGGCTATC GTGGCTGGCC ACGACGGGCG TTCCTTGCGC AGCTGTGCTC GACGTTGTCA
4201 CTGAAGCGGG AAGGGACTGG CTGCTATTGG GCGAAGTGCC GGGGCAGGAT CTCCTGTCAT
4261 CTCACCTTGC TCCTGCCGAG AAAGTATCCA TCATGGCTGA TGCAATGCGG CGGCTGCATA
4321 CGCTTGATCC GGCTACCTGC CCATTCGACC ACCAAGCGAA ACATCGCATC GAGCGAGCAC
```

FIG.46C

```
4381 GTACTCGGAT GGAAGCCGGT CTTGTCGATC AGGATGATCT GGACGAAGAG CATCAGGGGC
4441 TCGCGCCAGC CGAACTGTTC GCCAGGCTCA AGGCGCGCAT GCCCGACGGC GAGGATCTCG
4501 TCGTGACCCA TGGCGATGCC TGCTTGCCGA ATATCATGGT GGAAAATGGC CGCTTTTCTG
4561 GATTCATCGA CTGTGGCCGG CTGGGTGTGG CGGACCGCTA TCAGGACATA GCGTTGGCTA
4621 CCCGTGATAT TGCTGAAGAG CTTGGCGGCG AATGGGCTGA CCGCTTCCTC GTGCTTTACG
4681 GTATCGCCGC TCCCGATTCG CAGCGCATCG CCTTCTATCG CCTTCTTGAC GAGTTCTTCT
4741 GAGCGGGACT CTGGGGTTCG AAATGACCGA CCAAGCGACG CCCAACCTGC CATCACGATG
4801 GCCGCAATAA AATATCTTTA TTTTCATTAC ATCTGTGTGT TGGTTTTTTG TGTGAATCGA
4861 TAGCGATAAG GATCCGCGTA TGGTGCACTC TCAGTACAAT CTGCTCTGAT GCCGCATAGT
4921 TAAGCCAGCC CCGACACCCG CCAACACCCG CTGACGCGCC CTGACGGGCT TGTCTGCTCC
4981 CGGCATCCGC TTACAGACAA GCTGTGACCG TCTCCGGGAG CTGCATGTGT CAGAGGTTTT
5041 CACCGTCATC ACCGAAACGC GCGAGACGAA AGGGCCTCGT GATACGCCTA TTTTTATAGG
5101 TTAATGTCAT GATAATAATG GTTTCTTAGA CGTCAGGTGG CACTTTTCGG GGAAATGTGC
5161 GCGGAACCCC TATTTGTTTA TTTTTCTAAA TACATTCAAA TATGTATCCG CTCATGAGAC
5221 AATAACCCTG ATAAATGCTT CAATAATATT GAAAAAGGAA GAGTATGAGT ATTCAACATT
5281 TCCGTGTCGC CCTTATTCCC TTTTTTGCGG CATTTTGCCT TCCTGTTTTT GCTCACCCAG
5341 AAACGCTGGT GAAAGTAAAA GATGCTGAAG ATCAGTTGGG TGCACGAGTG GGTTACATCG
5401 AACTGGATCT CAACAGCGGT AAGATCCTTG AGAGTTTTCG CCCCGAAGAA CGTTTTCCAA
5461 TGATGAGCAC TTTTAAAGTT CTGCTATGTG GCGCGGTATT ATCCCGTATT GACGCCGGGC
5521 AAGAGCAACT CGGTCGCCGC ATACACTATT CTCAGAATGA CTTGGTTGAG TACTCACCAG
5581 TCACAGAAAA GCATCTTACG GATGGCATGA CAGTAAGAGA ATTATGCAGT GCTGCCATAA
5641 CCATGAGTGA TAACACTGCG GCCAACTTAC TTCTGACAAC GATCGGAGGA CCGAAGGAGC
5701 TAACCGCTTT TTTGCACAAC ATGGGGGATC ATGTAACTCG CCTTGATCGT TGGGAACCGG
5761 AGCTGAATGA AGCCATACCA AACGACGAGC GTGACACCAC GATGCCTGTA GCAATGGCAA
5821 CAACGTTGCG CAAACTATTA ACTGGCGAAC TACTTACTCT AGCTTCCCGG CAACAATTAA
5881 TAGACTGGAT GGAGGCGGAT AAAGTTGCAG GACCACTTCT GCGCTCGGCC CTTCCGGCTG
5941 GCTGGTTTAT TGCTGATAAA TCTGGAGCCG GTGAGCGTGG GTCTCGCGGT ATCATTGCAG
6001 CACTGGGGCC AGATGGTAAG CCCTCCCGTA TCGTAGTTAT CTACACGACG GGGAGTCAGG
6061 CAACTATGGA TGAACGAAAT AGACAGATCG CTGAGATAGG TGCCTCACTG ATTAAGCATT
6121 GGTAACTGTC AGACCAAGTT TACTCATATA TACTTTAGAT TGATTTAAAA CTTCATTTTT
6181 AATTTAAAAG GATCTAGGTG AAGATCCTTT TTGATAATCT CATGACCAAA ATCCCTTAAC
6241 GTGAGTTTTC GTTCCACTGA GCGTCAGACC CCGTAGAAAA GATCAAAGGA TCTTCTTGAG
6301 ATCCTTTTTT TCTGCGCGTA ATCTGCTGCT TGCAAACAAA AAAACCACCG CTACCAGCGG
6361 TGGTTTGTTT GCCGGATCAA GAGCTACCAA CTCTTTTTCC GAAGGTAACT GGCTTCAGCA
6421 GAGCGCAGAT ACCAAATACT GTCCTTCTAG TGTAGCCGTA GTTAGGCCAC CACTTCAAGA
6481 ACTCTGTAGC ACCGCCTACA TACCTCGCTC TGCTAATCCT GTTACCAGTG GCTGCTGCCA
6541 GTGGCGATAA GTCGTGTCTT ACCGGGTTGG ACTCAAGACG ATAGTTACCG GATAAGGCGC
6601 AGCGGTCGGG CTGAACGGGG GGTTCGTGCA CACAGCCCAG CTTGGAGCGA ACGACCTACA
6661 CCGAACTGAG ATACCTACAG CGTGAGCATT GAGAAAGCGC CACGCTTCCC GAAGGGAGAA
6721 AGGCGGACAG GTATCCGGTA AGCGGCAGGG TCGGAACAGG AGAGCGCACG AGGGAGCTTC
6781 CAGGGGGAAA CGCCTGGTAT CTTTATAGTC CTGTCGGGTT TCGCCACCTC TGACTTGAGC
6841 GTCGATTTTT GTGATGCTCG TCAGGGGGGC GGAGCCTATG GAAAAACGCC AGCAACGCGG
6901 CCTTTTTACG GTTCCTGGCC TTTTGCTGGC CTTTTGCTCA CATGTTCTTT CCTGCGTTAT
6961 CCCCTGATTC TGTGGATAAC CGTATTACCG CCTTTGAGTG AGCTGATACC GCTCGCCGCA
7021 GCCGAACGAC CGAGCGCAGC GAGTCAGTGA GCGAGGAAGC GGAAGAGCGC CCAATACGCA
7081 AACCGCCTCT CCCCGCGCGT TGGCCGATTC ATTAATGCAG AGCTTGCAAT TCGCGCGTTT
7141 TTCAATATTA TTGAAGCATT TATCAGGGTT ATTGTCTCAT GAGCGGATAC ATATTTGAAT
7201 GTATTTAGAA AAATAAACAA ATAGGGGTTC CGCGCACATT TCCCCGAAAA GTGCCACCTG
7261 ACGTCTAAGA AACCATTATT ATCATGACAT TAACCTATAA AAATAGGCGT AGTACGAGGC
7321 CCTTTCACTC ATTAGATGCA TGTCGTTACA TAACTTACGG TAAATGGCCC GCCTGGCTGA
7381 CCGCCCAACG ACCCCCGCCC ATTGACGTCA ATAATGACGT ATGTTCCCAT AGTAACGCCA
7441 ATAGGGACTT TCCATTGACG TCAATGGGTG GAGTATTTAC G
```

FIG.46D pDEST27 8123 bp (rotated to position 7800)

| Location (Base Nos.) | Gene Encoded |
|---|---|
| 130..793 | GST |
| 803..927 | attR1 |
| 1036..1695 | CmR |
| 1815..1899 | inactivated ccdA |
| 2037..2342 | ccdB |
| 2383..2507 | attR2 |
| 2693..3055 | SV40 polyA |
| 3250..3705 | f1 intergenic region |
| 3769..4187 | SV40 promoter |
| 4232..5026 | neo |
| 5090..5138 | polyA |
| 5549..6409 | Apr |
| 6558..7197 | ori |
| 7628..27 | CMV promoter |

```
   1 ATAAGCAGAG CTCGTTTAGT GAACCGTCAG ATCGCCTGGA GACGCCATCC ACGCTGTTTT
  61 GACCTCCATA GAAGACACCG GGACCGATCC AGCCTCCGGA CTCTAGCCTA GGCCGCGGAC
 121 CATGGCCCCT ATACTAGGTT ATTGGAAAAT TAAGGGCCTT GTGCAACCCA CTCGACTTCT
 181 TTTGGAATAT CTTGAAGAAA AATATGAAGA GCATTTGTAT GAGCGCGATG AAGGTGATAA
 241 ATGGCGAAAC AAAAAGTTTG AATTGGGTTT GGAGTTTCCC AATCTTCCTT ATTATATTGA
 301 TGGTGATGTT AAATTAACAC AGTCTATGGC CATCATACGT TATATAGCTG ACAAGCACAA
 361 CATGTTGGGT GGTTGTCCAA AAGAGCGTGC AGAGATTTCA ATGCTTGAAG GAGCGGTTTT
 421 GGATATTAGA TACGGTGTTT CGAGAATTGC ATATAGTAAA GACTTTGAAA CTCTCAAAGT
 481 TGATTTTCTT AGCAAGCTAC CTGAAATGCT GAAAATGTTC GAAGATCGTT TATGTCATAA
 541 AACATATTTA AATGGTGATC ATGTAACCCA TCCTGACTTC ATGTTGTATG ACGCTCTTGA
 601 TGTTGTTTTA TACATGGACC CAATGTGCCT GGATGCGTTC CCAAAATTAG TTTGTTTTAA
 661 AAAACGTATT GAAGCTATCC CACAAATTGA TAAGTACTTG AAATCCAGCA AGTATATAGC
 721 ATGGCCTTTG CAGGGCTGGC AAGCCACGTT TGGTGGTGGC GACCATCCTC AAAATCGGA
 781 TCTGGTTCCG CGTTCTAGAT CAACAAGTTT GTACAAAAAA GCTGAACGAG AAACGTAAAA
 841 TGATATAAAT ATCAATATAT TAAATTAGAT TTTGCATAAA AAACAGACTA CATAATACTG
 901 TAAAACACAA CATATCCAGT CACTATGGCG GCCGCATTAG CACCCCAGG CTTTACACTT
 961 TATGCTTCCG GCTCGTATAA TGTGTGGATT TTGAGTTAGG ATCCGGCGAG ATTTTCAGGA
1021 GCTAAGGAAG CTAAAATGGA GAAAAAAATC ACTGGATATA CCACCGTTGA TATATCCCAA
1081 TGGCATCGTA AAGAACATTT TGAGGCATTT CAGTCAGTTG CTCAATGTAC CTATAACCAG
1141 ACCGTTCAGC TGGATATTAC GGCCTTTTTA AAGACCGTAA AGAAAAATAA GCACAAGTTT
1201 TATCCGGCCT TTATTCACAT TCTTGCCCGC CTGATGAATG CTCATCCGGA ATTCCGTATG
```

FIG.47B

```
1261 GCAATGAAAG ACGGTGAGCT GGTGATATGG GATAGTGTTC ACCCTTGTTA CACCGTTTTC
1321 CATGAGCAAA CTGAAACGTT TTCATCGCTC TGGAGTGAAT ACCACGACGA TTTCCGGCAG
1381 TTTCTACACA TATATTCGCA AGATGTGGCG TGTTACGGTG AAAACCTGGC CTATTTCCCT
1441 AAAGGGTTTA TTGAGAATAT GTTTTTCGTC TCAGCCAATC CCTGGGTGAG TTTCACCAGT
1501 TTTGATTTAA ACGTGGCCAA TATGGACAAC TTCTTCGCCC CCGTTTTCAC CATGGGCAAA
1561 TATTATACGC AAGGCGACAA GGTGCTGATG CCGCTGGCGA TTCAGGTTCA TCATGCCGTC
1621 TGTGATGGCT TCCATGTCGG CAGAATGCTT AATGAATTAC AACAGTACTG CGATGAGTGG
1681 CAGGGCGGGG CGTAAAGATC TGGATCCGGC TTACTAAAAG CCAGATAACA GTATGCGTAT
1741 TTGCGCGCTG ATTTTTGCGG TATAAGAATA TATACTGATA TGTATACCCG AAGTATGTCA
1801 AAAAGAGGTG TGCTATGAAG CAGCGTATTA CAGTGACAGT TGACAGCGAC AGCTATCAGT
1861 TGCTCAAGGC ATATATGATG TCAATATCTC CGGTCTGGTA AGCACAACCA TGCAGAATGA
1921 AGCCCGTCGT CTGCGTGCCG AACGCTGGAA AGCGGAAAAT CAGGAAGGGA TGGCTGAGGT
1981 CGCCCGGTTT ATTGAAATGA ACGGCTCTTT TGCTGACGAG AACAGGGACT GGTGAAATGC
2041 AGTTTAAGGT TTACACCTAT AAAAGAGAGA GCCGTTATCG TCTGTTTGTG GATGTACAGA
2101 GTGATATTAT TGACACGCCC GGGCGACGGA TGGTGATCCC CCTGGCCAGT GCACGTCTGC
2161 TGTCAGATAA AGTCTCCCGT GAACTTTACC CGGTGGTGCA TATCGGGGAT GAAAGCTGGC
2221 GCATGATGAC CACCGATATG GCCAGTGTGC CGGTCTCCGT TATCGGGGAA GAAGTGGCTG
2281 ATCTCAGCCA CCGCGAAAAT GACATCAAAA ACGCCATTAA CCTGATGTTC TGGGGAATAT
2341 AAATGTCAGG CTCCCTTATA CACAGCCAGT CTGCAGGTCG ACCATAGTGA CTGGATATGT
2401 TGTGTTTTAC AGTATTATGT AGTCTGTTTT TTATGCAAAA TCTAATTTAA TATATTGATA
2461 TTTATATCAT TTTACGTTTC TCGTTCAGCT TTCTTGTACA AAGTGGTTGA TCGCGTGCAT
2521 GCGACGTCAT AGCTCTCTCC CTATAGTGAG TCGTATTATA AGCTAGGCAC TGGCCGTCGT
2581 TTTACAACGT CGTGACTGGG AAAACTGCTA GCTTGGGATC TTTGTGAAGG AACCTTACTT
2641 CTGTGGTGTG ACATAATTGG ACAAACTACC TACAGAGATT TAAAGCTCTA AGGTAAATAT
2701 AAAATTTTTA AGTGTATAAT GTGTTAAACT AGCTGCATAT GCTTGCTGCT TGAGAGTTTT
2761 GCTTACTGAG TATGATTTAT GAAAATATTA TACACAGGAG CTAGTGATTC TAATTGTTTG
2821 TGTATTTTAG ATTCACAGTC CCAAGGCTCA TTTCAGGCCC CTCAGTCCTC ACAGTCTGTT
2881 CATGATCATA ATCAGCCATA CCACATTTGT AGAGGTTTTA CTTGCTTTAA AAAACCTCCC
2941 ACACCTCCCC CTGAACCTGA AACATAAAAT GAATGCAATT GTTGTTGTTA ACTTGTTTAT
3001 TGCAGCTTAT AATGGTTACA AATAAAGCAA TAGCATCACA AATTTCACAA ATAAAGCATT
3061 TTTTTCACTG CATTCTAGTT GTGGTTTGTC CAAACTCATC AATGTATCTT ATCATGTCTG
3121 GATCGATCCT GCATTAATGA ATCGGCCAAC GCGCGGGGAG AGGCGGTTTG CGTATTGGCT
3181 GGCGTAATAG CGAAGAGGCC CGCACCGATC GCCCTTCCCA ACAGTTGCGC AGCCTGAATG
3241 GCGAATGGGA CGCGCCCTGT AGCGGCGCAT TAAGCGCGGC GGGTGTGGTG GTTACGCGCA
3301 GCGTGACCGC TACACTTGCC AGCGCCCTAG CGCCCGCTCC TTTCGCTTTC TTCCCTTCCT
3361 TTCTCGCCAC GTTCGCCGGC TTTCCCCGTC AAGCTCTAAA TCGGGGGCTC CCTTTAGGGT
3421 TCCGATTTAG TGCTTTACGG CACCTCGACC CCAAAAAACT TGATTAGGGT GATGGTTCAC
3481 GTAGTGGGCC ATCGCCCTGA TAGACGGTTT TTCGCCCTTT GACGTTGGAG TCCACGTTCT
3541 TTAATAGTGG ACTCTTGTTC CAAACTGGAA CAACACTCAA CCCTATCTCG GTCTATTCTT
3601 TTGATTTATA AGGGATTTTG CCGATTTCGG CCTATTGGTT AAAAAATGAG CTGATTTAAC
```

FIG.47C

```
3661 AAATATTTAA CGCGAATTTT AACAAAATAT TAACGTTTAC AATTTCGCCT GATGCGGTAT
3721 TTTCTCCTTA CGCATCTGTG CGGTATTTCA CACCGCATAC GCGGATCTGC GCAGCACCAT
3781 GGCCTGAAAT AACCTCTGAA AGAGGAACTT GGTTAGGTAC CTTCTGAGGC GGAAAGAACC
3841 AGCTGTGGAA TGTGTGTCAG TTAGGGTGTG GAAAGTCCCC AGGCTCCCCA GCAGGCAGAA
3901 GTATGCAAAG CATGCATCTC AATTAGTCAG CAACCAGGTG TGGAAAGTCC CCAGGCTCCC
3961 CAGCAGGCAG AAGTATGCAA AGCATGCATC TCAATTAGTC AGCAACCATA GTCCCGCCCC
4021 TAACTCCGCC CATCCCGCCC CTAACTCCGC CCAGTTCCGC CCATTCTCCG CCCCATGGCT
4081 GACTAATTTT TTTTATTTAT GCAGAGGCCG AGGCCGCCTC GGCCTCTGAG CTATTCCAGA
4141 AGTAGTGAGG AGGCTTTTTT GGAGGCCTAG GCTTTTGCAA AAAGCTTGAT TCTTCTGACA
4201 CAACAGTCTC GAACTTAAGG CTAGAGCCAC CATGATTGAA CAAGATGGAT TGCACGCAGG
4261 TTCTCCGGCC GCTTGGGTGG AGAGGCTATT CGGCTATGAC TGGGCACAAC AGACAATCGG
4321 CTGCTCTGAT GCCGCCGTGT TCCGGCTGTC AGCGCAGGGG CGCCCGGTTC TTTTTGTCAA
4381 GACCGACCTG TCCGGTGCCC TGAATGAACT GCAGGACGAG GCAGCGCGGC TATCGTGGCT
4441 GGCCACGACG GGCGTTCCTT GCGCAGCTGT GCTCGACGTT GTCACTGAAG CGGGAAGGGA
4501 CTGGCTGCTA TTGGGCGAAG TGCCGGGGCA GGATCTCCTG TCATCTCACC TTGCTCCTGC
4561 CGAGAAAGTA TCCATCATGG CTGATGCAAT GCGGCGGCTG CATACGCTTG ATCCGGCTAC
4621 CTGCCCATTC GACCACCAAG CGAAACATCG CATCGAGCGA GCACGTACTC GGATGGAAGC
4681 CGGTCTTGTC GATCAGGATG ATCTGGACGA AGAGCATCAG GGGCTCGCGC CAGCCGAACT
4741 GTTCGCCAGG CTCAAGGCGC GCATGCCCGA CGGCGAGGAT CTCGTCGTGA CCCATGGCGA
4801 TGCCTGCTTG CCGAATATCA TGGTGGAAAA TGGCCGCTTT TCTGGATTCA TCGACTGTGG
4861 CCGGCTGGGT GTGGCGGACC GCTATCAGGA CATAGCGTTG GCTACCCGTG ATATTGCTGA
4921 AGAGCTTGGC GGCGAATGGG CTGACCGCTT CCTCGTGCTT TACGGTATCG CCGCTCCCGA
4981 TTCGCAGCGC ATCGCCTTCT ATCGCCTTCT TGACGAGTTC TTCTGAGCGG GACTCTGGGG
5041 TTCGAAATGA CCGACCAAGC GACGCCCAAC CTGCCATCAC GATGGCCGCA ATAAAATATC
5101 TTTATTTTCA TTACATCTGT GTGTTGGTTT TTGTGTGAA TCGATAGCGA TAAGGATCCG
5161 CGTATGGTGC ACTCTCAGTA CAATCTGCTC TGATGCCGCA TAGTTAAGCC AGCCCGACA
5221 CCCGCCAACA CCCGCTGACG CGCCCTGACG GCTTGTCTG CTCCCGGCAT CCGCTTACAG
5281 ACAAGCTGTG ACCGTCTCCG GGAGCTGCAT GTGTCAGAGG TTTTCACCGT CATCACCGAA
5341 ACGCGCGAGA CGAAAGGGCC TCGTGATACG CCTATTTTTA TAGGTTAATG TCATGATAAT
5401 AATGGTTTCT TAGACGTCAG GTGGCACTTT TCGGGGAAAT GTGCGCGGAA CCCCTATTTG
5461 TTTATTTTTC TAAATACATT CAAATATGTA TCCGCTCATG AGACAATAAC CCTGATAAAT
5521 GCTTCAATAA TATTGAAAAA GGAAGAGTAT GAGTATTCAA CATTTCCGTG TCGCCCTTAT
5581 TCCCTTTTTT GCGGCATTTT GCCTTCCTGT TTTTGCTCAC CCAGAAACGC TGGTGAAAGT
5641 AAAAGATGCT GAAGATCAGT TGGGTGCACG AGTGGGTTAC ATCGAACTGG ATCTCAACAG
5701 CGGTAAGATC CTTGAGAGTT TTCGCCCCGA AGAACGTTTT CCAATGATGA GCACTTTTAA
5761 AGTTCTGCTA TGTGGCGCGG TATTATCCCG TATTGACGCC GGGCAAGAGC AACTCGGTCG
5821 CCGCATACAC TATTCTCAGA ATGACTTGGT TGAGTACTCA CCAGTCACAG AAAAGCATCT
5881 TACGGATGGC ATGACAGTAA GAGAATTATG CAGTGCTGCC ATAACCATGA GTGATAACAC
5941 TGCGGCCAAC TTACTTCTGA CAACGATCGG AGGACCGAAG GAGCTAACCG CTTTTTTGCA
6001 CAACATGGGG GATCATGTAA CTCGCCTTGA TCGTTGGGAA CCGGAGCTGA ATGAAGCCAT
```

FIG.47D

```
6061 ACCAAACGAC GAGCGTGACA CCACGATGCC TGTAGCAATG GCAACAACGT TGCGCAAACT
6121 ATTAACTGGC GAACTACTTA CTCTAGCTTC CCGGCAACAA TTAATAGACT GGATGGAGGC
6181 GGATAAAGTT GCAGGACCAC TTCTGCGCTC GGCCCTTCCG GCTGGCTGGT TTATTGCTGA
6241 TAAATCTGGA GCCGGTGAGC GTGGGTCTCG CGGTATCATT GCAGCACTGG GGCCAGATGG
6301 TAAGCCCTCC CGTATCGTAG TTATCTACAC GACGGGGAGT CAGGCAACTA TGGATGAACG
6361 AAATAGACAG ATCGCTGAGA TAGGTGCCTC ACTGATTAAG CATTGGTAAC TGTCAGACCA
6421 AGTTTACTCA TATATACTTT AGATTGATTT AAAACTTCAT TTTTAATTTA AAAGGATCTA
6481 GGTGAAGATC CTTTTTGATA ATCTCATGAC CAAAATCCCT TAACGTGAGT TTTCGTTCCA
6541 CTGAGCGTCA GACCCCGTAG AAAAGATCAA AGGATCTTCT TGAGATCCTT TTTTTCTGCG
6601 CGTAATCTGC TGCTTGCAAA CAAAAAAACC ACCGCTACCA GCGGTGGTTT GTTTGCCGGA
6661 TCAAGAGCTA CCAACTCTTT TTCCGAAGGT AACTGGCTTC AGCAGAGCGC AGATACCAAA
6721 TACTGTCCTT CTAGTGTAGC CGTAGTTAGG CCACCACTTC AAGAACTCTG TAGCACCGCC
6781 TACATACCTC GCTCTGCTAA TCCTGTTACC AGTGGCTGCT GCCAGTGGCG ATAAGTCGTG
6841 TCTTACCGGG TTGGACTCAA GACGATAGTT ACCGGATAAG GCGCAGCGGT CGGGCTGAAC
6901 GGGGGGTTCG TGCACACAGC CCAGCTTGGA GCGAACGACC TACACCGAAC TGAGATACCT
6961 ACAGCGTGAG CATTGAGAAA GCGCCACGCT TCCCGAAGGG AGAAAGGCGG ACAGGTATCC
7021 GGTAAGCGGC AGGGTCGGAA CAGGAGAGCG CACGAGGGAG CTTCCAGGGG GAAACGCCTG
7081 GTATCTTTAT AGTCCTGTCG GGTTTCGCCA CCTCTGACTT GAGCGTCGAT TTTTGTGATG
7141 CTCGTCAGGG GGGCGGAGCC TATGGAAAAA CGCCAGCAAC GCGGCCTTTT TACGGTTCCT
7201 GGCCTTTTGC TGGCCTTTTG CTCACATGTT CTTTCCTGCG TTATCCCCTG ATTCTGTGGA
7261 TAACCGTATT ACCGCCTTTG AGTGAGCTGA TACCGCTCGC CGCAGCCGAA CGACCGAGCG
7321 CAGCGAGTCA GTGAGCGAGG AAGCGGAAGA GCGCCCAATA CGCAAACCGC CTCTCCCCGC
7381 GCGTTGGCCG ATTCATTAAT GCAGAGCTTG CAATTCGCGC GTTTTTCAAT ATTATTGAAG
7441 CATTTATCAG GGTTATTGTC TCATGAGCGG ATACATATTT GAATGTATTT AGAAAAATAA
7501 ACAAATAGGG GTTCCGCGCA CATTTCCCCG AAAAGTGCCA CCTGACGTCT AAGAAACCAT
7561 TATTATCATG ACATTAACCT ATAAAAATAG GCGTAGTACG AGGCCCTTTC ACTCATTAGA
7621 TGCATGTCGT TACATAACTT ACGGTAAATG GCCCGCCTGG CTGACCGCCC AACGACCCCC
7681 GCCCATTGAC GTCAATAATG ACGTATGTTC CCATAGTAAC GCCAATAGGG ACTTTCCATT
7741 GACGTCAATG GGTGGAGTAT TTACGGTAAA CTGCCCACTT GGCAGTACAT CAAGTGTATC
7801 ATATGCCAAG TACGCCCCCT ATTGACGTCA ATGACGGTAA ATGGCCCGCC TGGCATTATG
7861 CCCAGTACAT GACCTTATGG GACTTTCCTA CTTGGCAGTA CATCTACGTA TTAGTCATCG
7921 CTATTACCAT GGTGATGCGG TTTTGGCAGT ACATCAATGG GCGTGGATAG CGGTTTGACT
7981 CACGGGGATT TCCAAGTCTC CACCCCATTG ACGTCAATGG GAGTTTGTTT TGGCACCAAA
8041 ATCAACGGGA CTTTCCAAAA TGTCGTAACA ACTCCGCCCC ATTGACGCAA ATGGGCGGTA
8101 GGCGTGTACG GTGGGAGGTC TAT
```

FIG.47E pEXP501(cont'd)

FEATURES OF THE attB CLONING VECTOR, pEXP501. BASES WITHIN HATCHED AREA ARE REPLACED BY cDNA IN SOME LTI cDNA LIBRARIES.

86B
⎯CMV mRNA

```
—aga gct cgt tta gtg aac cg|t cag atc gcc tgg aga cgc cat cca
—tct cga gca aat cac ttg gca gtc tag cgg acc tct gcg gta ggt cgc tgt ttt gac ctc cat aga aga cac cgg gac cga tcc agc ctc
gcg aca aaa ctg gag gta tct tct gtg gcc ctg gct agg tcg gag
```

SstI    LTI rev PRIMER
```
cgg act cta gcc tag gcc gcg|gag cgg ata aca att tca cac agg
gcc tga gat cgg atc cgg|cgc tcc gcc tat tgt taa agt gtg tcc
```

ABI rev PRIMER    Stu    SP6 PROMOTER    ⎯SP6
```
aaa cag cta tga cca tta ggc cta ttt agg tga cac tat aga|aca
ttt gtc gat act ggt aat ccg gat aaa tcc act gtg ata tct|tgt
```

Int    attB1    Age Kpn RsrII    EcoRI    Sma
```
agt ttg tac aaa aaa gca ggc tgg tac cgg tcc gga att ccc|ggg
tca aac atg ttt ttt cgt ccg acc atg gcc agg cct taa ggg|ccc
```

EcoRV Sal    Spe    Not    Xba
```
at|a tcg tcg acg agc tca cta gtc ggc|ggc cgc tct aga gta tcc
ta|t agc agc tgc tcg agt gat cag ccg|ccg gcg aga tct cat agg
```

XhoI    ApaI HindIII MIu    attB2    Int
```
ctc gag ggg ccc aag ctt acg cgt acc cag ctt tct tgt aca aag
gag ctc ccc ggg ttc gaa tgc gca tgg gtc gaa aga aca tgt ttc
```

```
tgg tcc cta tag tga gtc gta tta taa gct agg cac tgg ccg tcg
acc agg gat atc act cag cat aat att cga tcc gtg acc ggc agc
```
T7    T7 PROMOTER    ABI fwd Nhe    1272
```
ttt tac aac gtc gtg act ggg aaa act gct agc ttg gga tct ttg—
aaa atg ttg cag cac tga ccc ttt tga cga tcg aac cct aga aac—
```
LTI fwd

FIG.48B pEXP501 4396 bp

```
   1 CCATTCGCCA TTCAGGCTGC GCAACTGTTG GGAAGGGCGA TCGGTGCGGG CCTCTTCGCT
  61 ATTACGCCAG CCAATACGCA AACCGCCTCT CCCCGCGCGT TGGCCGATTC ATTAATGCAG
 121 GATCGATCCA GACATGATAA GATACATTGA TGAGTTTGGA CAAACCACAA CTAGAATGCA
 181 GTGAAAAAAA TGCTTTATTT GTGAAATTTG TGATGCTATT GCTTTATTTG TAACCATTAT
 241 AAGCTGCAAT AAACAAGTTA ACAACAACAA TTGCATTCAT TTTATGTTTC AGGTTCAGGG
 301 GGAGGTGTGG GAGGTTTTTT AAAGCAAGTA AAACCTCTAC AAATGTGGTA TGGCTGATTA
 361 TGATCATGAA CAGACTGTGA GGACTGAGGG GCCTGAAATG AGCCTTGGGA CTGTGAATCT
 421 AAAATACACA AACAATTAGA ATCACTAGCT CCTGTGTATA ATATTTTCAT AAATCATACT
 481 CAGTAAGCAA AACTCTCAAG CAGCAAGCAT ATGCAGCTAG TTTAACACAT TATACACTTA
 541 AAAATTTTAT ATTTACCTTA GAGCTTTAAA TCTCTGTAGG TAGTTTGTCC AATTATGTCA
 601 CACCACAGAA GTAAGGTTCC TTCACAAAGA TCCCAAGCTA GCAGTTTTCC CAGTCACGAC
 661 GTTGTAAAAC GACGGCCAGT GCCTAGCTTA TAATACGACT CACTATAGGG ACCACTTTGT
 721 ACAAGAAAGC TGGGTACGCG TAAGCTTGGG CCCCTCGAGG GATCCTCTAG AGCGGCCGCC
 781 GACTAGTGAG CTCGTCGACG ATATCCCGGG AATTCCGGAC CGGTACCAGC CTGCTTTTTT
 841 GTACAAACTT GTTCTATAGT GTCACCTAAA TAGGCCTAAT GGTCATAGCT GTTTCCTGTG
 901 TGAAATTGTT ATCCGCTCCG CGGCCTAGGC TAGAGTCCGG AGGCTGGATC GGTCCCGGTG
 961 TCTTCTATGG AGGTCAAAAC AGCGTGGATG GCGTCTCCAG GCGATCTGAC GGTTCACTAA
1021 ACGAGCTCTG CTTATATAGA CCTCCCACCG TACACGCCTA CCGCCCATTT GCGTCAATGG
1081 GGCGGAGTTG TTACGACATT TTGGAAAGTC CCGTTGATTT TGGTGCCAAA ACAAACTCCC
1141 ATTGACGTCA ATGGGGTGGA GACTTGGAAA TCCCCGTGAG TCAAACCGCT ATCCACGCCC
1201 ATTGATGTAC TGCCAAAACC GCATCACCAT GGTAATAGCG ATGACTAATA CGTAGATGTA
1261 CTGCCAAGTA GGAAAGTCCC ATAAGGTCAT GTACTGGGCA TAATGCCAGG CGGGCCATTT
1321 ACCGTCATTG ACGTCAATAG GGGGCGTACT TGGCATATGA TACACTTGAT GTACTGCCAA
1381 GTGGGCAGTT TACCGTAAAT ACTCCACCCA TTGACGTCAA TGGAAAGTCC CTATTGGCGT
1441 TACTATGGGA ACATACGTCA TTATTGACGT CAATGGGCGG GGGTCGTTGG GCGGTCAGCC
1501 AGGCGGGCCA TTTACCGTAA GTTATGTAAC GACATGCATC TAATGAGTGA AAGGGCCTCG
1561 TACTACGCCT ATTTTTATAG GTTAATGTCA TGATAATAAT GGTTTCTTAG ACGTCAGGTG
1621 GCACTTTTCG GGGAAATGTG CGCGGAACCC CTATTTGTTT ATTTTTCTAA ATACATTCAA
1681 ATATGTATCC GCTCATGAGA CAATAACCCT GATAAATGCT TCAATAATAT TGAAAAACGC
1741 GCGAATTGCA AGCTCTGCAT TAATGAATCG GCCAACGCGC GGGGAGAGGC GGTTTGCGTA
1801 TTGGGCGCTC TTCCGCTTCC TCGCTCACTG ACTCGCTGCG CTCGGTCGTT CGGCTGCGGC
1861 GAGCGGTATC AGCTCACTCA AAGGCGGTAA TACGGTTATC CACAGAATCA GGGGATAACG
1921 CAGGAAAGAA CATGTGAGCA AAAGGCCAGC AAAAGGCCAG GAACCGTAAA AAGGCCGCGT
1981 TGCTGGCGTT TTTCCATAGG CTCCGCCCCC CTGACGAGCA TCACAAAAAT CGACGCTCAA
2041 GTCAGAGGTG GCGAAACCCG ACAGGACTAT AAAGATACCA GGCGTTTCCC CCTGGAAGCT
2101 CCCTCGTGCG CTCTCCTGTT CCGACCCTGC CGCTTACCGG ATACCTGTCC GCCTTTCTCC
2161 CTTCGGGAAG CGTGGCGCTT TCTCAATGCT CACGCTGTAG GTATCTCAGT TCGGTGTAGG
```

FIG.48C

```
2221 TCGTTCGCTC CAAGCTGGGC TGTGTGCACG AACCCCCCGT TCAGCCCGAC CGCTGCGCCT
2281 TATCCGGTAA CTATCGTCTT GAGTCCAACC CGGTAAGACA CGACTTATCG CCACTGGCAG
2341 CAGCCACTGG TAACAGGATT AGCAGAGCGA GGTATGTAGG CGGTGCTACA GAGTTCTTGA
2401 AGTGGTGGCC TAACTACGGC TACACTAGAA GGACAGTATT TGGTATCTGC GCTCTGCTGA
2461 AGCCAGTTAC CTTCGGAAAA AGAGTTGGTA GCTCTTGATC CGGCAAACAA ACCACCGCTG
2521 GTAGCGGTGG TTTTTTTGTT TGCAAGCAGC AGATTACGCG CAGAAAAAAA GGATCTCAAG
2581 AAGATCCTTT GATCTTTTCT ACGGGGTCTG ACGCTCAGTG GAACGAAAAC TCACGTTAAG
2641 GGATTTTGGT CATGCCATAA CTTCGTATAG CATACATTAT ACGAAGTTAT GGCATGAGAT
2701 TATCAAAAAG GATCTTCACC TAGATCCTTT TAAATTAAAA ATGAAGTTTT AAATCAATCT
2761 AAAGTATATA TGAGTAAACT TGGTCTGACA GTTACCAATG CTTAATCAGT GAGGCACCTA
2821 TCTCAGCGAT CTGTCTATTT CGTTCATCCA TAGTTGCCTG ACTCCCCGTC GTGTAGATAA
2881 CTACGATACG GGAGGGCTTA CCATCTGGCC CCAGTGCTGC AATGATACCG CGAGACCCAC
2941 GCTCACCGGC TCCAGATTTA TCAGCAATAA ACCAGCCAGC CGGAAGGGCC GAGCGCAGAA
3001 GTGGTCCTGC AACTTTATCC GCCTCCATCC AGTCTATTAA TTGTTGCCGG GAAGCTAGAG
3061 TAAGTAGTTC GCCAGTTAAT AGTTTGCGCA ACGTTGTTGC CATTGCTACA GGCATCGTGG
3121 TGTCACGCTC GTCGTTTGGT ATGGCTTCAT TCAGCTCCGG TTCCCAACGA TCAAGGCGAG
3181 TTACATGATC CCCCATGTTG TGCAAAAAAG CGGTTAGCTC CTTCGGTCCT CCGATCGTTG
3241 TCAGAAGTAA GTTGGCCGCA GTGTTATCAC TCATGGTTAT GGCAGCACTG CATAATTCTC
3301 TTACTGTCAT GCCATCCGTA AGATGCTTTT CTGTGACTGG TGAGTACTCA ACCAAGTCAT
3361 TCTGAGAATA GTGTATGCGG CGACCGAGTT GCTCTTGCCC GGCGTCAATA CGGGATAATA
3421 CCGCGCCACA TAGCAGAACT TTAAAAGTGC TCATCATTGG AAAACGTTCT TCGGGGCGAA
3481 AACTCTCAAG GATCTTACCG CTGTTGAGAT CCAGTTCGAT GTAACCCACT CGTGCACCCA
3541 ACTGATCTTC AGCATCTTTT ACTTTCACCA GCGTTTCTGG GTGAGCAAAA ACAGGAAGGC
3601 AAAATGCCGC AAAAAAGGGA ATAAGGGCGA CACGGAAATG TTGAATACTC ATACTCTTCC
3661 TTTTTCAATA TTATTGAAGC ATTTATCAGG GTTATTGTCT CATGCCAGGG GTGGGCACAC
3721 ATATTTGATA CCAGCGATCC CTACACAGCA CATAATTCAA TGCGACTTCC CTCTATCGCA
3781 CATCTTAGAC CTTTATTCTC CCTCCAGCAC ACATCGAAGC TGCCGAGCAA GCCGTTCTCA
3841 CCAGTCCAAG ACCTGGCATG AGCGGATACA TATTTGAATG TATTTAGAAA AATAAACAAA
3901 TAGGGGTTCC GCGCACATTT CCCCGAAAAG TGCCACCTGA AATTGTAAAC GTTAATATTT
3961 TGTTAAAATT CGCGTTAAAT TTTTGTTAAA TCAGCTCATT TTTTAACCAA TAGGCCGAAA
4021 TCGGCAAAAT CCCTTATAAA TCAAAAGAAT AGACCGAGAT AGGGTTGAGT GTTGTTCCAG
4081 TTTGGAACAA GAGTCCACTA TTAAAGAACG TGGACTCCAA CGTCAAAGGG CGAAAAACCG
4141 TCTATCAGGG CGATGGCCCA CTACGTGAAC CATCACCCTA ATCAAGTTTT TTGGGGTCGA
4201 GGTGCCGTAA AGCACTAAAT CGGAACCCTA AAGGGAGCCC CCGATTTAGA GCTTGACGGG
4261 GAAAGCCGGC GAACGTGGCG AGAAAGGAAG GGAAGAAAGC GAAAGGAGCG GGCGCTAGGG
4321 CGCTGGCAAG TGTAGCGGTC ACGCTGCGCG TAACCACCAC ACCCGCCGCG CTTAATGCGC
4381 CGCTACAGGG CGCGTC
```

FIG.48D pDONR201 4470 bp (rotated to position 3516)

| Location (Base Nos.) | Gene Encoded |
|---|---|
| 260..29 | attP1 |
| 656..961 | ccdB |
| 1099..1184 | ccdA |
| 1303..1962 | CmR |
| 2210..2442 | attP2 |
| 2565..3374 | Kmr |
| 3495..4134 | ori |

```
   1 GTTAACGCTA GCATGGATCT CGGGCCCCAA ATAATGATTT TATTTTGACT GATAGTGACC
  61 TGTTCGTTGC AACAAATTGA TGAGCAATGC TTTTTTATAA TGCCAACTTT GTACAAAAAA
 121 GCTGAACGAG AAACGTAAAA TGATATAAAT ATCAATATAT TAAATTAGAT TTTGCATAAA
 181 AAACAGACTA CATAATACTG TAAAACACAA CATATCCAGT CACTATGAAT CAACTACTTA
 241 GATGGTATTA GTGACCTGTA GTCGACCGAC AGCCTTCCAA ATGTTCTTCG GGTGATGCTG
 301 CCAACTTAGT CGACCGACAG CCTTCCAAAT GTTCTTCTCA AACGGAATCG TCGTATCCAG
 361 CCTACTCGCT ATTGTCCTCA ATGCCGTATT AAATCATAAA AAGAAATAAG AAAAAGAGGT
 421 GCGAGCCTCT TTTTTGTGTG ACAAAATAAA AACATCTACC TATTCATATA CGCTAGTGTC
 481 ATAGTCCTGA AAATCATCTG CATCAAGAAC AATTTCACAA CTCTTATACT TTTCTCTTAC
 541 AAGTCGTTCG GCTTCATCTG GATTTTCAGC CTCTATACTT ACTAAACGTG ATAAAGTTTC
 601 TGTAATTTCT ACTGTATCGA CCTGCAGACT GGCTGTGTAT AAGGGAGCCT GACATTTATA
 661 TTCCCCAGAA CATCAGGTTA ATGGCGTTTT TGATGTCATT TTCGCGGTGG CTGAGATCAG
 721 CCACTTCTTC CCCGATAACG GAGACCGGCA CACTGGCCAT ATCGGTGGTC ATCATGCGCC
 781 AGCTTTCATC CCCGATATGC ACCACCGGGT AAAGTTCACG GGAGACTTTA TCTGACAGCA
 841 GACGTGCACT GGCCAGGGGG ATCACCATCC GTCGCCCGGG CGTGTCAATA ATATCACTCT
 901 GTACATCCAC AAACAGACGA TAACGGCTCT CTCTTTTATA GGTGTAAACC TTAAACTGCA
 961 TTTCACCAGT CCCTGTTCTC GTCAGCAAAA GAGCCGTTCA TTTCAATAAA CCGGGCGACC
1021 TCAGCCATCC CTTCCTGATT TTCCGCTTTC CAGCGTTCGG CACGCAGACG ACGGGCTTCA
1081 TTCTGCATGG TTGTGCTTAC CAGACCGGAG ATATTGACAT CATATATGCC TTGAGCAACT
1141 GATAGCTGTC GCTGTCAACT GTCACTGTAA TACGCTGCTT CATAGCACAC CTCTTTTTGA
1201 CATACTTCGG GTATACATAT CAGTATATAT TCTTATACCG CAAAAATCAG CGCGCAAATA
1261 CGCATACTGT TATCTGGCTT TTAGTAAGCC GGATCCACGC GATTACGCCC CGCCCTGCCA
1321 CTCATCGCAG TACTGTTGTA ATTCATTAAG CATTCTGCCG ACATGGAAGC CATCACAGAC
1381 GGCATGATGA ACCTGAATCG CCAGCGGCAT CAGCACCTTG TCGCCTTGCG TATAATATTT
1441 GCCCATGGTG AAAACGGGGG CGAAGAAGTT GTCCATATTG GCCACGTTTA AATCAAAACT
1501 GGTGAAACTC ACCCAGGGAT TGGCTGAGAC GAAAAACATA TTCTCAATAA ACCCTTTAGG
1561 GAAATAGGCC AGGTTTTCAC CGTAACACGC CACATCTTGC GAATATATGT GTAGAAACTG
1621 CCGGAAATCG TCGTGGTATT CACTCCAGAG CGATGAAAAC GTTTCAGTTT GCTCATGGAA
1681 AACGGTGTAA CAAGGGTGAA CACTATCCCA TATCACCAGC TCACCGTCTT TCATTGCCAT
1741 ACGGAATTCC GGATGAGCAT TCATCAGGCG GCAAGAATG TGAATAAAGG CCGGATAAAA
1801 CTTGTGCTTA TTTTTCTTTA CGGTCTTTAA AAAGGCCGTA ATATCCAGCT GAACGGTCTG
1861 GTTATAGGTA CATTGAGCAA CTGACTGAAA TGCCTCAAAA TGTTCTTTAC GATGCCATTG
1921 GGATATATCA ACGGTGGTAT ATCCAGTGAT TTTTTTCTCC ATTTTAGCTT CCTTAGCTCC
```

FIG.49B

```
1981 TGAAAATCTC GATAACTCAA AAAATACGCC CGGTAGTGAT CTTATTTCAT TATGGTGAAA
2041 GTTGGAACCT CTTACGTGCC GATCAACGTC TCATTTTCGC CAAAAGTTGG CCCAGGGCTT
2101 CCCGGTATCA ACAGGGACAC CAGGATTTAT TTATTCTGCG AAGTGATCTT CCGTCACAGG
2161 TATTTATTCG GCGCAAAGTG CGTCGGGTGA TGCTGCCAAC TTAGTCGACT ACAGGTCACT
2221 AATACCATCT AAGTAGTTGA TTCATAGTGA CTGGATATGT TGTGTTTTAC AGTATTATGT
2281 AGTCTGTTTT TTATGCAAAA TCTAATTTAA TATATTGATA TTTATATCAT TTTACGTTTC
2341 TCGTTCAGCT TTCTTGTACA AAGTTGGCAT TATAAGAAAG CATTGCTTAT CAATTTGTTG
2401 CAACGAACAG GTCACTATCA GTCAAAATAA AATCATTATT TGCCATCCAG CTGCAGCTCT
2461 GGCCCGTGTC TCAAAATCTC TGATGTTACA TTGCACAAGA TAAAAATATA TCATCATGAA
2521 CAATAAAACT GTCTGCTTAC ATAAACAGTA ATACAAGGGG TGTTATGAGC CATATTCAAC
2581 GGGAAACGTC GAGGCCGCGA TTAAATTCCA ACATGGATGC TGATTTATAT GGGTATAAAT
2641 GGGCTCGCGA TAATGTCGGG CAATCAGGTG CGACAATCTA TCGCTTGTAT GGGAAGCCCG
2701 ATGCGCCAGA GTTGTTTCTG AAACATGGCA AAGGTAGCGT TGCCAATGAT GTTACAGATG
2761 AGATGGTCAG ACTAAACTGG CTGACGGAAT TTATGCCTCT TCCGACCATC AAGCATTTTA
2821 TCCGTACTCC TGATGATGCA TGGTTACTCA CCACTGCGAT CCCCGGAAAA ACAGCATTCC
2881 AGGTATTAGA AGAATATCCT GATTCAGGTG AAAATATTGT TGATGCGCTG GCAGTGTTCC
2941 TGCGCCGGTT GCATTCGATT CCTGTTTGTA ATTGTCCTTT TAACAGCGAT CGCGTATTTC
3001 GTCTCGCTCA GGCGCAATCA CGAATGAATA ACGGTTTGGT TGATGCGAGT GATTTTGATG
3061 ACGAGCGTAA TGGCTGGCCT GTTGAACAAG TCTGGAAAGA AATGCATAAA CTTTTGCCAT
3121 TCTCACCGGA TTCAGTCGTC ACTCATGGTG ATTTCTCACT TGATAACCTT ATTTTTGACG
3181 AGGGGAAATT AATAGGTTGT ATTGATGTTG GACGAGTCGG AATCGCAGAC CGATACCAGG
3241 ATCTTGCCAT CCTATGGAAC TGCCTCGGTG AGTTTTCTCC TTCATTACAG AAACGGCTTT
3301 TTCAAAAATA TGGTATTGAT AATCCTGATA TGAATAAATT GCAGTTTCAT TTGATGCTCG
3361 ATGAGTTTTT CTAATCAGAA TTGGTTAATT GGTTGTAACA CTGGCAGAGC ATTACGCTGA
3421 CTTGACGGGA CGGCGCAAGC TCATGACCAA AATCCCTTAA CGTGAGTTTT CGTTCCACTG
3481 AGCGTCAGAC CCCGTAGAAA AGATCAAAGG ATCTTCTTGA GATCCTTTTT TTCTGCGCGT
3541 AATCTGCTGC TTGCAAACAA AAAAACCACC GCTACCAGCG GTGGTTTGTT TGCCGGATCA
3601 AGAGCTACCA ACTCTTTTTC CGAAGGTAAC TGGCTTCAGC AGAGCGCAGA TACCAAATAC
3661 TGTCCTTCTA GTGTAGCCGT AGTTAGGCCA CCACTTCAAG AACTCTGTAG CACCGCCTAC
3721 ATACCTCGCT CTGCTAATCC TGTTACCAGT GGCTGCTGCC AGTGGCGATA AGTCGTGTCT
3781 TACCGGGTTG GACTCAAGAC GATAGTTACC GGATAAGGCG CAGCGGTCGG GCTGAACGGG
3841 GGGTTCGTGC ACACAGCCCA GCTTGGAGCG AACGACCTAC ACCGAACTGA GATACCTACA
3901 GCGTGAGCTA TGAGAAAGCG CCACGCTTCC CGAAGGGAGA AAGGCGGACA GGTATCCGGT
3961 AAGCGGCAGG GTCGGAACAG GAGAGCGCAC GAGGGAGCTT CCAGGGGGAA ACGCCTGGTA
4021 TCTTTATAGT CCTGTCGGGT TTCGCCACCT CTGACTTGAG CGTCGATTTT TGTGATGCTC
4081 GTCAGGGGGG CGGAGCCTAT GGAAAAACGC CAGCAACGCG GCCTTTTTAC GGTTCCTGGC
4141 CTTTTGCTGG CCTTTTGCTC ACATGTTCTT TCCTGCGTTA TCCCCTGATT CTGTGGATAA
4201 CCGTATTACC GCTAGCCAGG AAGAGTTTGT AGAAACGCAA AAAGGCCATC CGTCAGGATG
4261 GCCTTCTGCT TAGTTTGATG CCTGGCAGTT TATGGCGGGC GTCCTGCCCG CCACCCTCCG
4321 GGCCGTTGCT TCACAACGTT CAAATCCGCT CCCGGCGGAT TTGTCCTACT CAGGAGAGCG
4381 TTCACCGACA AACAACAGAT AAAACGAAAG CCCAGTCTT CCGACTGAGC CTTTCGTTTT
4441 ATTTGATGCC TGGCAGTTCC CTACTCTCGC
```

FIG.49C pDONR202 4204 bp

| Location (Base Nos.) | Gene Encoded |
|---|---|
| 369..127 | attP1 |
| 486..1059 | ori |
| 1228..2107 | KmR |
| 2381..2140 | attP2 |
| 2629..3288 | CmR |
| 3408..3492 | inactivated ccdA |
| 3630..3935 | ccdB |

```
   1 CGGCATTGAG GACAATAGCG AGTAGGCTGG ATACGACGAT TCCGTTTGAG AAGAACATTT
  61 GGAAGGCTGT CGGTCGACTA AGTTGGCAGC ATCACCCGAA GAACATTTGG AAGGCTGTCG
 121 GTCGACTACA GGTCACTAAT ACCATCTAAG TAGTTGATTC ATAGTGACTG GATATGTTGT
 181 GTTTTACAGT ATTATGTAGT CTGTTTTTTA TGCAAAATCT AATTTAATAT ATTGATATTT
 241 ATATCATTTT ACGTTTCTCG TTCAGCTTTT TTGTACAAAG TTGGCATTAT AAAAAAGCAT
 301 TGCTCATCAA TTTGTTGCAA CGAACAGGTC ACTATCAGTC AAAATAAAAT CATTATTTGG
 361 GGCCCGAGAT CCATGCTAGC GGTAATACGG TTATCCACAG AATCAGGGGA TAACGCAGGA
 421 AAGAACATGT GAGCAAAAGG CCAGCAAAAG GCCAGGAACC GTAAAAAGGC CGCGTTGCTG
 481 GCGTTTTTCC ATAGGCTCCG CCCCCCTGAC GAGCATCACA AAAATCGACG CTCAAGTCAG
 541 AGGTGGCGAA ACCCGACAGG ACTATAAAGA TACCAGGCGT TTCCCCCTGG AAGCTCCCTC
 601 GTGCGCTCTC CTGTTCCGAC CCTGCCGCTT ACCGGATACC TGTCCGCCTT TCTCCCTTCG
 661 GGAAGCGTGG CGCTTTCTCA TAGCTCACGC TGTAGGTATC TCAGTTCGGT GTAGGTCGTT
 721 CGCTCCAAGC TGGGCTGTGT GCACGAACCC CCCGTTCAGC CCGACCGCTG CGCCTTATCC
 781 GGTAACTATC GTCTTGAGTC CAACCCGGTA AGACACGACT TATCGCCACT GGCAGCAGCC
 841 ACTGGTAACA GGATTAGCAG AGCGAGGTAT GTAGGCGGTG CTACAGAGTT CTTGAAGTGG
 901 TGGCCTAACT ACGGCTACAC TAGAAGGACA GTATTTGGTA TCTGCGCTCT GCTGAAGCCA
 961 GTTACCTTCG GAAAAAGAGT TGGTAGCTCT TGATCCGGCA AACAAACCAC CGCTGGTAGC
1021 GGTGGTTTTT TTGTTTGCAA GCAGCAGATT ACGCGCAGAA AAAAAGGATC TCAAGAAGAT
1081 CCTTTGATCT TTTCTACGGG GTCTGACGCT CAGTGGAACG AAAACTCACG TTAAGGGATT
1141 TTGGTCATGA GCTTGCGCCG TCCCGTCAAG TCAGCGTAAT GCTCTGCCAG TGTTACAACC
1201 AATTAACCAA TTCTGATTAG AAAAACTCAT CGAGCATCAA ATGAAACTGC AATTTATTCA
1261 TATCAGGATT ATCAATACCA TATTTTTGAA AAAGCCGTTT CTGTAATGAA GGAGAAAACT
1321 CACCGAGGCA GTTCCATAGG ATGGCAAGAT CCTGGTATCG GTCTGCGATT CCGACTCGTC
1381 CAACATCAAT ACAACCTATT AATTTCCCCT CGTCAAAAAT AAGGTTATCA AGTGAGAAAT
1441 CACCATGAGT GACGACTGAA TCCGGTGAGA ATGGCAAAAG TTTATGCATT TCTTTCCAGA
1501 CTTGTTCAAC AGGCCAGCCA TTACGCTCGT CATCAAAATC ACTCGCATCA ACCAAACCGT
1561 TATTCATTCG TGATTGCGCC TGAGCGAGAC GAAATACGCG ATCGCTGTTA AAAGGACAAT
1621 TACAAACAGG AATCGAATGC AACCGGCGCA GGAACACTGC CAGCGCATCA ACAATATTTT
1681 CACCTGAATC AGGATATTCT TCTAATACCT GGAATGCTGT TTTTCCGGGG ATCGCAGTGG
```

FIG.50B

```
1741 TGAGTAACCA TGCATCATCA GGAGTACGGA TAAAATGCTT GATGGTCGGA AGAGGCATAA
1801 ATTCCGTCAG CCAGTTTAGT CTGACCATCT CATCTGTAAC ATCATTGGCA ACGCTACCTT
1861 TGCCATGTTT CAGAAACAAC TCTGGCGCAT CGGGCTTCCC ATACAAGCGA TAGATTGTCG
1921 CACCTGATTG CCCGACATTA TCGCGAGCCC ATTTATACCC ATATAAATCA GCATCCATGT
1981 TGGAATTTAA TCGCGGCCTC GACGTTTCCC GTTGAATATG GCTCATAACA CCCCTTGTAT
2041 TACTGTTTAT GTAAGCAGAC AGTTTTATTG TTCATGATGA TATATTTTTA TCTTGTGCAA
2101 TGTAACATCA GAGATTTTGA GACACGGGCC AGAGCTGCAG CTGGATGGCA AATAATGATT
2161 TTATTTTGAC TGATAGTGAC CTGTTCGTTG CAACAAATTG ATAAGCAATG CTTTCTTATA
2221 ATGCCAACTT TGTACAAGAA AGCTGAACGA GAAACGTAAA ATGATATAAA TATCAATATA
2281 TTAAATTAGA TTTTGCATAA AAAACAGACT ACATAATACT GTAAAACACA ACATATCCAG
2341 TCACTATGAA TCAACTACTT AGATGGTATT AGTGACCTGT AGTCGACTAA GTTGGCAGCA
2401 TCACCCGACG CACTTTGCGC CGAATAAATA CCTGTGACGG AAGATCACTT CGCAGAATAA
2461 ATAAATCCTG GTGTCCCTGT TGATACCGGG AAGCCCTGGG CCAACTTTTG GCGAAAATGA
2521 GACGTTGATC GGCACGTAAG AGGTTCCAAC TTTCACCATA ATGAAATAAG ATCACTACCG
2581 GGCGTATTTT TTGAGTTATC GAGATTTTCA GGAGCTAAGG AAGCTAAAAT GGAGAAAAAA
2641 ATCACTGGAT ATACCACCGT TGATATATCC CAATGGCATC GTAAAGAACA TTTTGAGGCA
2701 TTTCAGTCAG TTGCTCAATG TACCTATAAC CAGACCGTTC AGCTGGATAT TACGGCCTTT
2761 TTAAAGACCG TAAAGAAAAA TAAGCACAAG TTTTATCCGG CCTTTATTCA CATTCTTGCC
2821 CGCCTGATGA ATGCTCATCC GGAATTCCGT ATGGCAATGA AAGACGGTGA GCTGGTGATA
2881 TGGGATAGTG TTCACCCTTG TTACACCGTT TTCCATGAGC AAACTGAAAC GTTTTCATCG
2941 CTCTGGAGTG AATACCACGA CGATTTCCGG CAGTTTCTAC ACATATATTC GCAAGATGTG
3001 GCGTGTTACG GTGAAAACCT GGCCTATTTC CCTAAAGGGT TTATTGAGAA TATGTTTTTC
3061 GTCTCAGCCA ATCCCTGGGT GAGTTTCACC AGTTTTGATT TAAACGTGGC CAATATGGAC
3121 AACTTCTTCG CCCCCGTTTT CACCATGGGC AAATATTATA CGCAAGGCGA CAAGGTGCTG
3181 ATGCCGCTGG CGATTCAGGT TCATCATGCC GTCTGTGATG GCTTCCATGT CGGCAGAATG
3241 CTTAATGAAT TACAACAGTA CTGCGATGAG TGGCAGGGCG GGGCGTAATC GCGTGGATCC
3301 GGCTTACTAA AAGCCAGATA ACAGTATGCG TATTTGCGCG CTGATTTTTG CGGTATAAGA
3361 ATATATACTG ATATGTATAC CCGAAGTATG TCAAAAAGAG GTGTGCTATG AAGCAGCGTA
3421 TTACAGTGAC AGTTGACAGC GACAGCTATC AGTTGCTCAA GGCATATATG ATGTCAATAT
3481 CTCCGGTCTG GTAAGCACAA CCATGCAGAA TGAAGCCCGT CGTCTGCGTG CCGAACGCTG
3541 GAAAGCGGAA AATCAGGAAG GGATGGCTGA GGTCGCCCGG TTTATTGAAA TGAACGGCTC
3601 TTTTGCTGAC GAGAACAGGG ACTGGTGAAA TGCAGTTTAA GGTTTACACC TATAAAAGAG
3661 AGAGCCGTTA TCGTCTGTTT GTGGATGTAC AGAGTGATAT TATTGACACG CCCGGGCGAC
3721 GGATGGTGAT CCCCCTGGCC AGTGCACGTC TGCTGTCAGA TAAAGTCTCC CGTGAACTTT
3781 ACCCGGTGGT GCATATCGGG GATGAAAGCT GGCGCATGAT GACCACCGAT ATGGCCAGTG
3841 TGCCGGTCTC CGTTATCGGG GAAGAAGTGG CTGATCTCAG CCACCGCGAA AATGACATCA
3901 AAAACGCCAT TAACCTGATG TTCTGGGGAA TATAAATGTC AGGCTCCCTT ATACACAGCC
3961 AGTCTGCAGG TCGATACAGT AGAAATTACA GAAACTTTAT CACGTTTAGT AAGTATAGAG
4021 GCTGAAAATC CAGATGAAGC CGAACGACTT GTAAGAGAAA AGTATAAGAG TTGTGAAATT
4081 GTTCTTGATG CAGATGATTT TCAGGACTAT GACACTAGCG TATATGAATA GGTAGATGTT
4141 TTTATTTTGT CACACAAAAA AGAGGCTCGC ACCTCTTTTT CTTATTTCTT TTTATGATTT
4201 AATA
```

FIG.50C pDONR203 4208 bp

| Location (Base Nos.) | Gene Encoded |
|---|---|
| 47..131 | inactivated ccdA |
| 251..910 | CmR |
| 1158..1398 | attP2 |
| 1509..2082 | ori |
| 2251..3130 | KmR |
| 3464..3174 | attP1 |
| 3812..4117 | ccdB |

```
   1 GCGTTCGGCA CGCAGACGAC GGGCTTCATT CTGCATGGTT GTGCTTACCA GACCGGAGAT
  61 ATTGACATCA TATATGCCTT GAGCAACTGA TAGCTGTCGC TGTCAACTGT CACTGTAATA
 121 CGCTGCTTCA TAGCACACCT CTTTTTGACA TACTTCGGGT ATACATATCA GTATATATTC
 181 TTATACCGCA AAAATCAGCG CGCAAATACG CATACTGTTA TCTGGCTTTT AGTAAGCCGG
 241 ATCCACGCGT TTACGCCCCG CCCTGCCACT CATCGCAGTA CTGTTGTAAT TCATTAAGCA
 301 TTCTGCCGAC ATGGAAGCCA TCACAGACGG CATGATGAAC CTGAATCGCC AGCGGCATCA
 361 GCACCTTGTC GCCTTGCGTA TAATATTTGC CCATGGTGAA AACGGGGGCG AAGAAGTTGT
 421 CCATATTGGC CACGTTTAAA TCAAAACTGG TGAAACTCAC CCAGGGATTG GCTGAGACGA
 481 AAAACATATT CTCAATAAAC CCTTTAGGGA AATAGGCCAG GTTTTCACCG TAACACGCCA
 541 CATCTTGCGA ATATATGTGT AGAAACTGCC GGAAATCGTC GTGGTATTCA CTCCAGAGCG
 601 ATGAAAACGT TTCAGTTTGC TCATGGAAAA CGGTGTAACA AGGGTGAACA CTATCCCATA
 661 TCACCAGCTC ACCGTCTTTC ATTGCCATAC GGAATTCCGG ATGAGCATTC ATCAGGCGGG
 721 CAAGAATGTG AATAAAGGCC GGATAAAACT TGTGCTTATT TTTCTTTACG GTCTTTAAAA
 781 AGGCCGTAAT ATCCAGCTGA ACGGTCTGGT TATAGGTACA TTGAGCAACT GACTGAAATG
 841 CCTCAAAATG TTCTTTACGA TGCCATTGGG ATATATCAAC GGTGGTATAT CCAGTGATTT
 901 TTTTCTCCAT TTTAGCTTCC TTAGCTCCTG AAAATCTCGA TAACTCAAAA AATACGCCCG
 961 GTAGTGATCT TATTTCATTA TGGTGAAAGT TGGAACCTCT TACGTGCCGA TCAACGTCTC
1021 ATTTTCGCCA AAAGTTGGCC CAGGGCTTCC CGGTATCAAC AGGGACACCA GGATTTATTT
1081 ATTCTGCGAA GTGATCTTCC GTCACAGGTA TTTATTCGGC GCAAAGTGCG TCGGGTGATG
1141 CTGCCAACTT AGTCGACTAC AGGTCACTAA TACCATCTAA GTAGTTGATT CATAGTGACT
1201 GGATATGTTG TGTTTTACAG TATTATGTAG TCTGTTTTTT ATGCAAAATC TAATTTAATA
1261 TATTGATATT TATATCATTT TACGTTTCTC GTTCAGCTTT CTTGTACAAA GTTGGCATTA
1321 TAAGAAAGCA TTGCTTATCA ATTTGTTGCA ACGAACAGGT CACTATCAGT CAAAATAAAA
1381 TCATTATTTG CCATCCAGCT AGCGGTAATA CGGTTATCCA CAGAATCAGG GGATAACGCA
1441 GGAAAGAACA TGTGAGCAAA AGGCCAGCAA AAGGCCAGGA ACCGTAAAAA GGCCGCGTTG
1501 CTGGCGTTTT TCCATAGGCT CCGCCCCCCT GACGAGCATC ACAAAAATCG ACGCTCAAGT
1561 CAGAGGTGGC GAAACCCGAC AGGACTATAA AGATACCAGG CGTTTCCCCC TGGAAGCTCC
1621 CTCGTGCGCT CTCCTGTTCC GACCCTGCCG CTTACCGGAT ACCTGTCCGC CTTTCTCCCT
1681 TCGGGAAGCG TGGCGCTTTC TCATAGCTCA CGCTGTAGGT ATCTCAGTTC GGTGTAGGTC
1741 GTTCGCTCCA AGCTGGGCTG TGTGCACGAA CCCCCCGTTC AGCCCGACCG CTGCGCCTTA
1801 TCCGGTAACT ATCGTCTTGA GTCCAACCCG GTAAGACACG ACTTATCGCC ACTGGCAGCA
1861 GCCACTGGTA ACAGGATTAG CAGAGCGAGG TATGTAGGCG GTGCTACAGA GTTCTTGAAG
1921 TGGTGGCCTA ACTACGGCTA CACTAGAAGA ACAGTATTTG GTATCTGCGC TCTGCTGAAG
```

```
1981 CCAGTTACCT TCGGAAAAAG AGTTGGTAGC TCTTGATCCG GCAAACAAAC CACCGCTGGT
2041 AGCGGTGGTT TTTTTGTTTG CAAGCAGCAG ATTACGCGCA GAAAAAAAGG ATCTCAAGAA
2101 GATCCTTTGA TCTTTTCTAC GGGGTCTGAC GCTCAGTGGA ACGAAAACTC ACGTTAAGGG
2161 ATTTTGGTCA TGAGCTTGCG CCGTCCCGTC AAGTCAGCGT AATGCTCTGC CAGTGTTACA
2221 ACCAATTAAC CAATTCTGAT TAGAAAAACT CATCGAGCAT CAAATGAAAC TGCAATTTAT
2281 TCATATCAGG ATTATCAATA CCATATTTTT GAAAAAGCCG TTTCTGTAAT GAAGGAGAAA
2341 ACTCACCGAG GCAGTTCCAT AGGATGGCAA GATCCTGGTA TCGGTCTGCG ATTCCGACTC
2401 GTCCAACATC AATACAACCT ATTAATTTCC CCTCGTCAAA AATAAGGTTA TCAAGTGAGA
2461 AATCACCATG AGTGACGACT GAATCCGGTG AGAATGGCAA AAGTTTATGC ATTTCTTTCC
2521 AGACTTGTTC AACAGGCCAG CCATTACGCT CGTCATCAAA ATCACTCGCA TCAACCAAAC
2581 CGTTATTCAT TCGTGATTGC GCCTGAGCGA GACGAAATAC GCGATCGCTG TTAAAAGGAC
2641 AATTACAAAC AGGAATCGAA TGCAACCGGC GCAGGAACAC TGCCAGCGCA TCAACAATAT
2701 TTTCACCTGA ATCAGGATAT TCTTCTAATA CCTGGAATGC TGTTTTTCCG GGGATCGCAG
2761 TGGTGAGTAA CCATGCATCA TCAGGAGTAC GGATAAAATG CTTGATGGTC GGAAGAGGCA
2821 TAAATTCCGT CAGCCAGTTT AGTCTGACCA TCTCATCTGT AACATCATTG GCAACGCTAC
2881 CTTTGCCATG TTTCAGAAAC AACTCTGGCG CATCGGGCTT CCCATACAAG CGATAGATTG
2941 TCGCACCTGA TTGCCCGACA TTATCGCGAG CCCATTTATA CCCATATAAA TCAGCATCCA
3001 TGTTGGAATT TAATCGCGGC CTCGACGTTT CCCGTTGAAT ATGGCTCATA ACACCCCTTG
3061 TATTACTGTT TATGTAAGCA GACAGTTTTA TTGTTCATGA TGATATATTT TTATCTTGTG
3121 CAATGTAACA TCAGAGATTT TGAGACACGG GCCAGAGCTG CAGCTAGCAT GGATCTCGGG
3181 CCCCAAATAA TGATTTTATT TTGACTGATA GTGACCTGTT CGTTGCAACA AATTGATGAG
3241 CAATGCTTTT TTATAATGCC AACTTTGTAC AAAAAAGCTG AACGAGAAAC GTAAAATGAT
3301 ATAAATATCA ATATATTAAA TTAGATTTTG CATAAAAAAC AGACTACATA ATACTGTAAA
3361 ACACAACATA TCCAGTCACT ATGAATCAAC TACTTAGATG GTATTAGTGA CCTGTAGTCG
3421 ACCGACAGCC TTCCAAATGT TCTTCGGGTG ATGCTGCCAA CTTAGTCGAC CGACAGCCTT
3481 CCAAATGTTC TTCTCAAACG GAATCGTCGT ATCCAGCCTA CTCGCTATTG TCCTCAATGC
3541 CGTATTAAAT CATAAAAAGA AATAAGAAAA AGAGGTGCGA GCCTCTTTTT TGTGTGACAA
3601 AATAAAAACA TCTACCTATT CATATACGCT AGTGTCATAG TCCTGAAAAT CATCTGCATC
3661 AAGAACAATT TCACAACTCT TATACTTTTC TCTTACAAGT CGTTCGGCTT CATCTGGATT
3721 TTCAGCCTCT ATACTTACTA AACGTGATAA AGTTTCTGTA ATTTCTACTG TATCGACCTG
3781 CAGACTGGCT GTGTATAAGG GAGCCTGACA TTTATATTCC CCAGAACATC AGGTTAATGG
3841 CGTTTTTGAT GTCATTTTCG CGGTGGCTGA GATCAGCCAC TTCTTCCCCG ATAACGGAGA
3901 CCGGCACACT GGCCATATCG GTGGTCATCA TGCGCCAGCT TCATCCCCG ATATGCACCA
3961 CCGGGTAAAG TTCACGGGAG ACTTTATCTG ACAGCAGACG TGCACTGGCC AGGGGGATCA
4021 CCATCCGTCG CCCGGGCGTG TCAATAATAT CACTCTGTAC ATCCACAAAC AGACGATAAC
4081 GGCTCTCTCT TTTATAGGTG TAAACCTTAA ACTGCATTTC ACCAGTCCCT GTTCTCGTCA
4141 GCAAAAGAGC CGTTCATTTC AATAAACCGG GCGACCTCAG CCATCCCTTC CTGATTTTCC
4201 GCTTTCCA
```

FIG.51C pDONR204 4165 bp

```
   1 CGGCATTGAG GACAATAGCG AGTAGGCTGG ATACGACGAT TCCGTTTGAG AAGAACATTT
  61 GGAAGGCTGT CGGTCGACTA CAGGTCACTA ATACCATCTA AGTAGTTGAA TCATAGTGAC
 121 TGGATATGTT GTGTTTTACA GTATTATGTA GTCTGTTTTT TATGCAAAAT CTAATTTAAT
 181 ATATTGATAT TTATATCATT TTACGTTTCT CGTTCAGCTT TTTTGTACAA AGTTGGCATT
 241 ATAAAAAAGC ATTGCTTATC AATTTGTTGC AACGAACAGG TCACTATCAG TCAAAATAAA
 301 ATCATTATTT GGGGCCCGAG ATCCATGCTA GCTGCAGTGC GCAGGGCCCG TGTCTCAAAA
 361 TCTCTGATGT TACATTGCAC AAGATAAAAA TATATCATCA TGAACAATAA AACTGTCTGC
 421 TTACATAAAC AGTAATACAA GGGGTGTTAT GAGCCATATT CAACGGGAAA CGTCTTGCTG
 481 GAGGCCGCGA TTAAATTCCA ACATGGATGC TGATTTATAT GGGTATAAAT GGGCTCGCGA
 541 TAATGTCGGG CAATCAGGTG CGACAATCTT TCGATTGTAT GGGAAGCCCG ATGCGCCAGA
 601 GTTGTTTCTG AAACATGGCA AAGGTAGCGT TGCCAATGAT GTTACAGATG AGATGGTCAG
 661 ACTAAACTGG CTGACGGAAT TTATGCCTCT TCCGACCATC AAGCATTTTA TCCGTACTCC
 721 TGATGATGCA TGGTTACTCA CCACTGCGAT CCGCGGGAAA ACAGCATTCC AGGTATTAGA
 781 AGAATATCCT GATTCAGGTG AAAATATTGT TGATGCGCTG GCAGTGTTCC TGCGCCGGTT
 841 GCATTCGATT CCTGTTTGTA ATTGTCCTTT TAACAGCGAT CGCGTATTTC GTCTCGCTCA
 901 GGCGCAATCA CGAATGAATA ACGGTTTGGT TGATGCGAGT GATTTTGATG ACGAGCGTAA
 961 TGGCTGGCCT GTTGAACAAG TCTGGAAAGA AATGCATACG CTTTTGCCAT TCTCACCGGA
1021 TTCAGTCGTC ACTCATGGTG ATTTCTCACT TGATAACCTT ATTTTTGACG AGGGGAAATT
1081 AATAGGTTGT ATTGATGTTG GACGAGTCGG AATCGCAGAC CGATACCAGG ATCTTGCCAT
1141 CCTATGGAAC TGCCTCGGTG AGTTTTCTCC TTCATTACAG AAACGGCTTT TTCAAAAATA
1201 TGGTATTGAT AATCCTGATA TGAATAAATT GCAGTTTCAT TTGATGCTCG ATGAGTTTTT
1261 CTAATCAGAA TTGGTTAATT GGTTGTAACA CTGGCAGAGC ATTACGCTGA CTTGACGGGA
1321 CGGCGNCATG ACCAAAATCC CTTAACGTGA GTTTTCGTTC CACTGAGCGT CAGACCCCGT
1381 AGAAAAGATC AAAGGATCTT CTTGAGATCC TTTTTTTCTG CGCGTAATCT GCTGCTTGCA
1441 AACAAAAAAA CCACCGCTAC CAGCGGTGGT TTGTTTGCCG GATCAAGAGC TACCAACTCT
1501 TTTTCCGAAG GTAACTGGCT TCAGCAGAGC GCAGATACCA AATACTGTCC TTCTAGTGTA
1561 GCCGTAGTTA GGCCACCACT TCAAGAACTC TGTAGCACCG CCTACATACC TCGCTCTGCT
1621 AATCCTGTTA CCAGTGGCTG CTGCCAGTGG CGATAAGTCG TGTCTTACCG GGTTGGACTC
1681 AAGACGATAG TTACCGGATA AGGCGCAGCG GTCGGGCTGA ACGGGGGGTT CGTGCACACA
1741 GCCCAGCTTG GAGCGAACGA CCTACACCGA ACTGAGATAC CTACAGCGTG AGCTATGAGA
1801 AAGCGCCACG CTTCCCGAAG GGAGAAAGGC GGACAGGTAT CCGGTAAGCG GCAGGGTCGG
1861 AACAGGAGAG CGCACGAGGG AGCTTCCAGG GGGAAACGCC TGGTATCTTT ATAGTCCTGT
1921 CGGGTTTCGC CACCTCTGAC TTGAGCGTCG ATTTTTGTGA TGCTCGTCAG GGGGCGGAG
1981 CCTATGGAAA AACGCCAGCA ACGCGGCCTT TTTACGGTTC CTGGCCTTTT GCTGGCCTTT
2041 TGCTCACATG TTCTTTCCTG CGTTATCCCC TGATTCTGTG GATAACCGTA TTACCGCTAG
2101 CTGGATCGGC AAATAATGAT TTTATTTTGA CTGATAGTGA CCTGTTCGTT GCAACAAATT
2161 GATAAGCAAT GCTTTTTTAT AATGCCAACT TTGTACAAGA AAGCTGAACG AGAAACGTAA
```

FIG.52B

```
2221 AATGATATAA ATATCAATAT ATTAAATTAG ATTTTGCATA AAAAACAGAC TACATAATAC
2281 TGTAAAACAC AACATATCCA GTCACTATGA TTCAACTACT TAGATGGTAT TAGTGACCTG
2341 TAGTCGACTA AGTTGGCAGC ATCACCCGAC GCACTTTGCG CCGAATAAAT ACCTGTGACG
2401 GAAGATCACT TCGCAGAATA AATAAATCCT GGTGTCCCTG TTGATACCGG GAAGCCCTGG
2461 GCCAACTTTT GGCGAAAATG AGACGTTGAT CGGCACATTT CACAACTCTT ATACTTTTCT
2521 CTTACAAGTC GTTCGGCTTC ATCTGGATTT TCAGCCTCTA TACTTACTAA ACGTGATAAA
2581 GTTTCTGTAA TTTCTACTGT ATCGACCTGC AGACTGGCTG TGTATAACGG AGCCTGACAT
2641 TTATATTCCC CAGAACATCA GGTTAATGGC GTTTTTGATG TCATTTTCGC GGTGGCTGAG
2701 ATCAGCCACT TCTTCCCCGA TAACGGAGAC CGGCACACTG GCCATATCGG TGGTCATCAT
2761 GCGCCAGCTT TCATCCCCGA TATGCACCAC CGGGTAAAGT TCACGGGAGA CTTTATCTGA
2821 CAGCAGACGT GCACTGGCCA GGGGGATCAC CATCCGTCGC CCGGGCGTGT CAATAATATC
2881 ACTCTGTACA TCCACAAACA GACGATAACG GCTCTCTCTT TTATAGGTGT AAACCTTAAA
2941 CTGCATTTCA CCAGTCCCTG TTCTCGTCAG CAAAAGAGCC GTTCATTTCA ATAAACCGGG
3001 CGACCTCAGC CATCCCTTCC TGATTTTCCG CTTTCCAGCG TTCGGCACGC AGACGACGGG
3061 CTTCATTCTG CATGGTTGTG CTTACCAGAC CGGAGATATT GACATCATAT ATGCCTTGAG
3121 CAACTGATAG CTGTCGCTGT CAACTGTCAC TGTAATACGC TGCTTCATAG CACACCTCTT
3181 TTTGACATAC TTCGGGTATA CATATCAGTA TATATTCTTA TACCGCAAAA ATCAGCGCGC
3241 AAATACGCAT ACTGTTATCT GGCTTTTAGT AAGCCGGATC CACGCGTTTA CGCCCCGCCC
3301 TGCCACTCAT CGCAGTACTG TTGTAATTCA TTAAGCATTC TGCCGACATG GAAGCCATCA
3361 CAGACGGCAT GATGAACCTG AATCGCCAGC GGCATCAGCA CCTTGTCGCC TTGCGTATAA
3421 TATTTGCCCA TGGTGAAAAC GGGGGCGAAG AAGTTGTCCA TATTGGCCAC GTTTAAATCA
3481 AAACTGGTGA AACTCACCCA GGGATTGGCT GAGACGAAAA ACATATTCTC AATAAACCCT
3541 TTAGGGAAAT AGGCCAGGTT TTCACCGTAA CACGCCACAT CTTGCGAATA TATGTGTAGA
3601 AACTGCCGGA AATCGTCGTG GTATTCACTC CAGAGCGATG AAAACGTTTC AGTTTGCTCA
3661 TGGAAAACGG TGTAACAAGG GTGAACACTA TCCCATATCA CCAGCTCACC GTCTTTCATT
3721 GCCATACGGA ATTCCGGATG AGCATTCATC AGGCGGGCAA GAATGTGAAT AAAGGCCGGA
3781 TAAAACTTGT GCTTATTTTT CTTTACGGTC TTTAAAAAGG CCGTAATATC CAGCTGAACG
3841 GTCTGGTTAT AGGTACATTG AGCAACTGAC TGAAATGCCT CAAAATGTTC TTTACGATGC
3901 CATTGGGATA TATCAACGGT GGTATATCCA GTGATTTTTT TCTCCATTTT AGCTTCCTTA
3961 GCTCCTGAAA ATCTCGATAA CTCAAAAAAT ACGCCCGGTA GTGATCTTAT TTCATTATGG
4021 TGAAAGTTGG AACCTCTTAC TGTTCTTGAT GCAGATGATT TTCAGGACTA TGACACTAGC
4081 ATATATGAAT AGGTAGATGT TTTTATTTTG TCACACAAAA AAGAGGCTCG CACCTCTTTT
4141 TCTTATTTCT TTTTATGATT TAATA
```

FIG. 52C pDONR205 4939 bp

```
GGCATCAGCACCTTGTCGCCTTGCGTATAATATTTGCCCATGGTGAAAACGGGGGCGAAG
AAGTTGTCCATATTGGCCACGTTTAAATCAAAACTGGTGAAACTCACCCAGGGATTGGCT
GAGACGAAAAACATATTCTCAATAAACCCTTTAGGGAAATAGGCCAGGTTTTCACCGTAA
CACGCCACATCTTGCGAATATATGTGTAGAAACTGCCGGAAATCGTCGTGGTATTCACTC
CAGAGCGATGAAAACGTTTCAGTTTGCTCATGGAAAACGGTGTAACAAGGGTGAACACTA
TCCCATATCACCAGCTCACCGTCTTTCATTGCCATACGGAATTCCGGATGAGCATTCATC
AGGCGGGCAAGAATGTGAATAAAGGCCGGATAAAACTTGTGCTTATTTTTCTTTACGGTC
TTTAAAAAGGCCGTAATATCCAGCTGAACGGTCTGGTTATAGGTACATTGAGCAACTGAC
TGAAATGCCTCAAAATGTTCTTTACGATGCCATTGGGATATATCAACGGTGGTATATCCA
GTGATTTTTTTCTCCATTTTAGCTTCCTTAGCTCCTGAAAATCTCGATAACTCAAAAAAT
ACGCCCGGTAGTGATCTTATTTCATTATGGTGAAAGTTGGAACCTCTTACGTGCCGATCA
ACGTCTCATTTTCGCCAAAAGTTGGCCCAGGGCTTCCCGGTATCAACAGGGACACCAGGA
TTTATTTATTCTGCGAAGTGATCTTCCGTCACAGGTATTTATTCGGCGCAAAGTGCGTCG
GGTGATGCTGCCAACTTAGTCGACTACAGGTCACTAATACCATCTAAGTAGTTGATTCAT
AGTGACTGGATATGTTGTGTTTACAGTATTATGTAGTCTGTTTTTTATGCAAAATCTAA
TTTAATATATTGATATTTATATCATTTTACGTTTCTCGTTCAGCTTTCTTGTACAAAGTT
GGCATTATAAGAAAGCATTGCTTATCAATTTGTTGCAACGAACAGGTCACTATCAGTCAA
AATAAAATCATTATTTGCCATCCAGCTGCAGCTCTGGCCCGTGTCTCAAAATCTCTGATG
TTACATTGCACAAGATAAAAATATATCATCATGAATTCTCATGTTTGACAGCTTATCATC
GATAAGCTTTAATGCGGTAGTTTATCACAGTTAAATTGCTAACGCAGTCAGGCACCGTGT
ATGAAATCTAACAATGCGCTCATCGTCATCCTCGGCACCGTCACCCTGGATGCTGTAGGC
ATAGGCTTGGTTATGCCGGTACTGCCGGGCCTCTTGCGGGATATCGTCCATTCCGACAGC
ATCGCCAGTCACTATGGCGTGCTGCTAGCGCTATATGCGTTGATGCAATTTCTATGCGCA
CCCGTTCTCGGAGCACTGTCCGACCGCTTTGGCCGCCGCCCAGTCCTGCTCGCTTCGCTA
CTTGGAGCCACTATCGACTACGCGATCATGGCGACCACACCCGTCCTGTGGATCCTCTAC
GCCGGACGCATCGTGGCCGGCATCACCGGCGCCACAGGTGCGGTTGCTGGCGCCTATATC
GCCGACATCACCGATGGGGAAGATCGGGCTCGCCACTTCGGGCTCATGAGCGCTTGTTTC
GGCGTGGGTATGGTGGCAGGCCCCGTGGCCGGGGGACTGTTGGGCGCCATCTCCTTGCAT
GCACCATTCCTTGCGGCGGCGGTGCTCAACGGCCTCAACCTACTACTGGGCTGCTTCCTA
ATGCAGGAGTCGCATAAGGGAGAGCGTCGACCGATGCCCTTGAGAGCCTTCAACCCAGTC
AGCTCCTTCCGGTGGGCGCGGGGCATGACTATCGTCGCCGCACTTATGACTGTCTTCTTT
ATCATGCAACTCGTAGGACAGGTGCCGGCAGCGCTCTGGGTCATTTTCGGCGAGGACCGC
TTTCGCTGGAGCGCGACGATGATCGGCCTGTCGCTTGCGGTATTCGGAATCTTGCACGCC
CTCGCTCAAGCCTTCGTCACTGGTCCCGCCACCAAACGTTTCGGCGAGAAGCAGGCCATT
ATCGCCGGCATGGCGGCCGACGCGCTGGGCTACGTCTTGCTGGCGTTCGCGACGCGAGGC
TGGATGGCCTTCCCCATTATGATTCTTCTCGCTTCCGGCGGCATCGGGATGCCCGCGTTG
CAGGCCATGCTGTCCAGGCAGGTAGATGACGACCATCAGGGACAGCTTCAAGGATCGCTC
GCGGCTCTTACCAGCCTAACTTCGATCATTGGACCGCTGATCGTCACGGCGATTTATGCC
GCCTCGGCGAGCACATGGAACGGGTTGGCATGGATTGTAGGCGCCGCCCTATACCTTGTC
TGCCTCCCCGCGTTGCGTCGCGGTGCATGGAGCCGGGCCACCTCGACCTGAATGGAAGCC
GGCGGCACCTCGCTAACGGATTCACCACTCCAAGAATTGGAGCCAATCAATTCTTGCGGA
GAACTGTGAATGCGCAAACCAACCCTTGGCAGAACATATCCATCGCATGACCAAAATCCC
```

FIG.53B

```
TTAACGTGAGTTTTCGTTCCACTGAGCGTCAGACCCCGTAGAAAAGATCAAAGGATCTTC
TTGAGATCCTTTTTTTTCTGCGCGTAATCTGCTGCTTGCAAACAAAAAAACCACCGCTACC
AGCGGTGGTTTGTTTGCCGGATCAAGAGCTACCAACTCTTTTTCCGAAGGTAACTGGCTT
CAGCAGAGCGCAGATACCAAATACTGTCCTTCTAGTGTAGCCGTAGTTAGGCCACCACTT
CAAGAACTCTGTAGCACCGCCTACATACCTCGCTCTGCTAATCCTGTTACCAGTGGCTGC
TGCCAGTGGCGATAAGTCGTGTCTTACCGGGTTGGACTCAAGACGATAGTTACCGGATAA
GGCGCAGCGGTCGGGCTGAACGGGGGGTTCGTGCACACAGCCCAGCTTGGAGCGAACGAC
CTACACCGAACTGAGATACCTACAGCGTGAGCTATGAGAAAGCGCCACGCTTCCCGAAGG
GAGAAAGGCGGACAGGTATCCGGTAAGCGGCAGGGTCGGAACAGGAGAGCGCACGAGGGA
GCTTCCAGGGGGAAACGCCTGGTATCTTTATAGTCCTGTCGGGTTTCGCCACCTCTGACT
TGAGCGTCGATTTTTGTGATGCTCGTCAGGGGGCGGAGCCTATGGAAAAACGCCAGCAA
CGCGGCCTTTTTACGGTTCCTGGCCTTTTGCTGGCCTTTTGCTCACATGTTCTTTCCTGC
GTTATCCCCTGATTCTGTGGATAACCGTATTACCGCTAGCCAGGAAGAGTTTGTAGAAAC
GCAAAAAGGCCATCCGTCAGGATGGCCTTCTGCTTAGTTTGATGCCTGGCAGTTTATGGC
GGGCGTCCTGCCCGCCACCCTCCGGGCCGTTGCTTCACAACGTTCAAATCCGCTCCCGGC
GGATTTGTCCTACTCAGGAGAGCGTTCACCGACAAACAACAGATAAAACGAAAGGCCCAG
TCTTCCGACTGAGCCTTTCGTTTTATTTGATGCCTGGCAGTTCCCTACTCTCGCGTTAAC
GCTAGCATGGATCTCGGGCCCCAAATAATGATTTTATTTTGACTGATAGTGACCTGTTCG
TTGCAACAAATTGATGAGCAATGCTTTTTTATAATGCCAACTTTGTACAAAAAAGCTGAA
CGAGAAACGTAAAATGATATAAATATCAATATATTAAATTAGATTTTGCATAAAAAACAG
ACTACATAATACTGTAAAACACAACATATCCAGTCACTATGAATCAACTACTTAGATGGT
ATTAGTGACCTGTAGTCGACCGACAGCCTTCCAAATGTTCTTCGGGTGATGCTGCCAACT
TAGTCGACCGACAGCCTTCCAAATGTTCTTCTCAAACGGAATCGTCGTATCCAGCCTACT
CGCTATTGTCCTCAATGCCGTATTAAATCATAAAAAGAAATAAGAAAAAGAGGTGCGAGC
CTCTTTTTTGTGTGACAAAATAAAAACATCTACCTATTCATATACGCTAGTGTCATAGTC
CTGAAAATCATCTGCATCAAGAACAATTTCACAACTCTTATACTTTTCTCTTACAAGTCG
TTCGGCTTCATCTGGATTTTCAGCCTCTATACTTACTAAACGTGATAAAGTTTCTGTAAT
TTCTACTGTATCGACCTGCAGACTGGCTGTGTATAAGGGAGCCTGACATTTATATTCCCC
AGAACATCAGGTTAATGGCGTTTTTGATGTCATTTTCGCGGTGGCTGAGATCAGCCACTT
CTTCCCCGATAACGGAGACCGGCACACTGGCCATATCGGTGGTCATCATGCGCCAGCTTT
CATCCCCGATATGCACCACCGGGTAAAGTTCACGGGAGACTTTATCTGACAGCAGACGTG
CACTGGCCAGGGGGATCACCATCCGTCGCCCGGGCGTGTCAATAATATCACTCTGTACAT
CCACAAACAGACGATAACGGCTCTCTCTTTTATAGGTGTAAACCTTAAACTGCATTTCAC
CAGTCCCTGTTCTCGTCAGCAAAAGAGCCGTTCATTTCAATAAACCGGGCGACCTCAGCC
ATCCCTTCCTGATTTTCCGCTTTCCAGCGTTCGGCACGCAGACGACGGGCTTCATTCTGC
ATGGTTGTGCTTACCAGACCGGAGATATTGACATCATATATGCCTTGAGCAACTGATAGC
TGTCGCTGTCAACTGTCACTGTAATACGCTGCTTCATAGCACACCTCTTTTTGACATACT
TCGGGTATACATATCAGTATATATTCTTATACCGCAAAAATCAGCGCGCAAATACGCATA
CTGTTATCTGGCTTTTAGTAAGCCGGATCCACGCGATTACGCCCCGCCCTGCCACTCATC
GCAGTACTGTTGTAATTCATTAAGCATTCTGCCGACATGGAAGCCATCACAGACGGCATG
ATGAACCTGAATCGCCAGC
```

FIG.53C pDONR206 4415 bp

```
CGGCATTGAGGACAATAGCGAGTAGGCTGGATACGACGATTCCGTTTGAGAAGAACATTT
GGAAGGCTGTCGGTCGACTACAGGTCACTAATACCATCTAAGTAGTTGAATCATAGTGAC
TGGATATGTTGTGTTTTACAGTATTATGTAGTCTGTTTTTTTATGCAAAATCTAATTTAAT
ATATTGATATTTATATCATTTTACGTTTCTCGTTCAGCTTTTTTGTACAAAGTTGGCATT
ATAAAAAAGCATTGCTTATCAATTTGTTGCAACGAACAGGTCACTATCAGTCAAAATAAA
ATCATTATTTGGGGCCCGAGATCCATGCTAGCGGTAATACGGTTATCCACAGAATCAGGG
GATAACGCAGGAAAGAACATGTGAGCAAAAGGCCAGCAAAAGGCCAGGAACCGTAAAAAG
GCCGCGTTGCTGGCGTTTTTCCATAGGCTCCGCCCCCCTGACGAGCATCACAAAAATCGA
CGCTCAAGTCAGAGGTGGCGAAACCCGACAGGACTATAAAGATACCAGGCGTTTCCCCCT
GGAAGCTCCCTCGTGCGCTCTCCTGTTCCGACCCTGCCGCTTACCGGATACCTGTCCGCC
TTTCTCCCTTCGGGAAGCGTGGCGCTTTCTCATAGCTCACGCTGTAGGTATCTCAGTTCG
GTGTAGGTCGTTCGCTCCAAGCTGGGCTGTGTGCACGAACCCCCCGTTCAGCCCGACCGC
TGCGCCTTATCCGGTAACTATCGTCTTGAGTCCAACCCGGTAAGACACGACTTATCGCCA
CTGGCAGCAGCCACTGGTAACAGGATTAGCAGAGCGAGGTATGTAGGCGGTGCTACAGAG
TTCTTGAAGTGGTGGCCTAACTACGGCTACACTAGAAGGACAGTATTTGGTATCTGCGCT
CTGCTGAAGCCAGTTACCTTCGGAAAAAGAGTTGGTAGCTCTTGATCCGGCAAACAAACC
ACCGCTGGTAGCGGTGGTTTTTTTGTTTGCAAGCAGCAGATTACGCGCAGAAAAAAAGGA
TCTCAAGAAGATCCTTTGATCTTTTCTACGGGGTCTGACGCTCAGTGGAACGAAAACTCA
CGTTAAGGGATTTTGGTCATGNGCCGTCCCGTCAAGTCAGCGTAATGCTCTGCCAGTGT
TACAACCAATTAACCAATTCTGATTAGAAAAACTCATCGAGCATCAAATGAAACTGCAAT
TTATTCATATCAGGATTATCAATACCATATTTTTGAAAAAGCCGTTTCTGTAATGAAGGA
GAAAACTCACCGAGGCAGTTCCATAGGATGGCAAGATCCTGGTATCGGTCTGCGATTCCG
ACTCGTCCAACATCAATACAACCTATTAGCCGAGGTCTTCCGATCTCCTGAAGCCAGGGC
AGATCCGTGCACAGCACCTTGCCGTAGAAGAACAGCAAGGCCGCCAATGCCTGACGATGC
GTGGAGACCGAAACCTTGCGCTCGTTCGCCAGCCAGGACAGAAATGCCTCGACTTCGCTG
CTGCCCAAGGTTGCCGGGTGACGCACACCGTGGAAACGGATGAAGGCACGAACCCAGTTG
ACATAAGCCTGTTCGGTTCGTAAACTGTAATGCAAGTAGCGTATGCGCTCACGCAACTGG
TCCAGAACCTTGACCGAACGCAGCGGTGGTAACGGCGCAGTGGCGGTTTTCATGGCTTGT
TATGACTGTTTTTTTGTACAGTCTATGCCTCGGGCATCCAAGCAGCAAGCGCGTTACGCC
GTGGGTCGATGTTTGATGTTATGGAGCAGCAACGATGTTACGCAGCAGCAACGATGTTAC
GCAGCAGGGCAGTCGCCCTAAAACAAAGTTAGGTGGCTCAAGTATGGGCATCATTCGCAC
ATGTAGGCTCGGCCCTGACCAAGTCAAATCCATGCGGGCTGCTCTTGATCTTTTCGGTCG
TGAGTTCGGAGACGTAGCCACCTACTCCCAACATCAGCCGGACTCCGATTACCTCGGGAA
CTTGCTCCGTAGTAAGACATTCATCGCGCTTGCTGCCTTCGACCAAGAAGCGGTTGTTGG
CGCTCTCGCGGCTTACGTTCTGCCCAGGTTTGAGCAGCCGCGTAGTGAGATCTATATCTA
TGATCTCGCAGTCTCCGGCGAGCACCGGAGGCAGGGCATTGCCACCGCGCTCATCAATCT
CCTCAAGCATGAGGCCAACGCGCTTGGTGCTTATGTGATCTACGTGCAAGCAGATTACGG
TGACGATCCCGCAGTGGCTCTCTATACAAAGTTGGGCATACGGGAAGAAGTGATGCACTT
TGATATCGACCCAAGTACCGCCACCTAACAATTCGTTCAAGCCGAGATCGGCTTCCCGGC
CTAATTTCCCCTCGTCAAAAATAAGGTTATCAAGTGAGAAATCACCATGAGTGACGACTG
AATCCGGTGAGAATGGCAAAAGCGTATGCATTTCTTTCCAGACTTGTTCAACAGGCCAGC
CATTACGCTCGTCATCAAAATCACTCGCATCAACCAAACCGTTATTCATTCGTGATTGCG
```

FIG.54B

```
CCTGAGCGAGACGAAATACGCGATCGCTGTTAAAAGGACAATTACAAACAGGAATCGAAT
GCAACCGGCGCAGGAACACTGCCAGCGCATCAACAATATTTTCACCTGAATCAGGATATT
CTTCTAATACCTGGAATGCTGTTTTCCCGCGGATCGCAGTGGTGAGTAACCATGCATCAT
CAGGAGTACGGATAAAATGCTTGATGGTCGGAAGAGGCATAAATTCCGTCAGCCAGTTTA
GTCTGACCATCTCATCTGTAACATCATTGGCAACGCTACCTTTGCCATGTTTCAGAAACA
ACTCTGGCGCATCGGGCTTCCCATACAATCGAAAGATTGTCGCACCTGATTGCCCGACAT
TATCGCGAGCCCATTTATACCCATATAAATCAGCATCCATGTTGGAATTTAATCGCGGCC
TCCAGCAAGACGTTTCCCGTTGAATATGGCTCATAACACCCCTTGTATTACTGTTTATGT
AAGCAGACAGTTTTATTGTTCATGATGATATATTTTATCTTGTGCAATGTAACATCAGA
GATTTTGAGACACGGGCCCNGCGCACTGCAGCTGGATCGGCAAATAATGATTTTATTTTG
ACTGATAGTGACCTGTTCGTTGCAACAAATTGATAAGCAATGCTTTTTTATAATGCCAAC
TTTGTACAAGAAAGCTGAACGAGAAACGTAAAATGATATAAATATCAATATATTAAATTA
GATTTTGCATAAAAAACAGACTACATAATACTGTAAAACACAACATATCCAGTCACTATG
ATTCAACTACTTAGATGGTATTAGTGACCTGTAGTCGACTAAGTTGGCAGCATCACCCGA
CGCACTTTGCGCCGAATAAATACCTGTGACGGAAGATCACTTCGCAGAATAAATAAATCC
TGGTGTCCCTGTTGATACCGGGAAGCCCTGGGCCAACTTTTGGCGAAAATGAGACGTTGA
TCGGCACGTAAGAGGTTCCAACTTTCACCATAATGAAATAAGATCACTACCGGGCGTATT
TTTTGAGTTATCGAGATTTTCAGGAGCTAAGGAAGCTAAAATGGAGAAAAAAATCACTGG
ATATACCACCGTTGATATATCCCAATGGCATCGTAAAGAACATTTTGAGGCATTTCAGTC
AGTTGCTCAATGTACCTATAACCAGACCGTTCAGCTGGATATTACGGCCTTTTTAAAGAC
CGTAAAGAAAAATAAGCACAAGTTTTATCCGGCCTTTATTCACATTCTTGCCCGCCTGAT
GAATGCTCATCCGGAATTCCGTATGGCAATGAAAGACGGTGAGCTGGTGATATGGGATAG
TGTTCACCCTTGTTACACCGTTTTCCATGAGCAAACTGAAACGTTTTCATCGCTCTGGAG
TGAATACCACGACGATTTCCGGCAGTTTCTACACATATATTCGCAAGATGTGGCGTGTTA
CGGTGAAAACCTGGCCTATTTCCCTAAAGGGTTTATTGAGAATATGTTTTTCGTCTCAGC
CAATCCCTGGGTGAGTTTCACCAGTTTTGATTTAAACGTGGCCAATATGGACAACTTCTT
CGCCCCCGTTTTCACCATGGGCAAATATTATACGCAAGGCGACAAGGTGCTGATGCCGCT
GGCGATTCAGGTTCATCATGCCGTCTGTGATGGCTTCCATGTCGGCAGAATGCTTAATGA
ATTACAACAGTACTGCGATGAGTGGCAGGGCGGGGCGTAAACGCGTGGATCCGGCTTACT
AAAAGCCAGATAACAGTATGCGTATTTGCGCGCTGATTTTTGCGGTATAAGAATATATAC
TGATATGTATACCCGAAGTATGTCAAAAAGAGGTGTGCTATGAAGCAGCGTATTACAGTG
ACAGTTGACAGCGACAGCTATCAGTTGCTCAAGGCATATATGATGTCAATATCTCCGGTC
TGGTAAGCACAACCATGCAGAATGAAGCCCGTCGTCTGCGTGCCGAACGCTGGAAAGCGG
AAAATCAGGAAGGGATGGCTGAGGTCGCCCGGTTTATTGAAATGAACGGCTCTTTTGCTG
ACGAGAACAGGGACTGGTGAAATGCAGTTTAAGGTTTACACCTATAAAAGAGAGAGCCGT
TATCGTCTGTTTGTGGATGTACAGAGTGATATTATTGACACGCCCGGGCGACGGATGGTG
ATCCCCCTGGCCAGTGCACGTCTGCTGTCAGATAAAGTCTCCCGTGAACTTTACCCGGTG
GTGCATATCGGGGATGAAAGCTGGCGCATGATGACCACCGATATGGCCAGTGTGCCGGTC
TCCGTTATCGGGGAAGAAGTGGCTGATCTCAGCCACCGCGAAAATGACATCAAAACGCC
ATTAACCTGATGTTCTGGGGAATATAAATGTCAGGCTCCGTTATACACAGCCAGTCTGCA
GGTCGATACAGTAGAAATTACAGAAACTTTATCACGTTTAGTAAGTATAGAGGCTGAAAA
TCCAGATGAAGCCGAACGACTTGTAAGAGAAAAGTATAAGAGTTGTGAAATTGTTCTTGA
TGCAGATGATTTTCAGGACTATGACACTAGCATATATGAATAGGTAGATGTTTTTATTTT
GTCACACAAAAAAGAGGCTCGCACCTCTTTTTCTTATTTCTTTTTATGATTTAATA
```

FIG.54C

An Entry (pENTR7) Clone of CAT Subcloned into pDEST2

```
                                                   ┌─Start translation
                                                   │                      ──────▶
                                                   │Met Ser Tyr Tyr  His His His
1021 cgg ata aca att tca cac agg aaa cag acc│atg tcg tac tac cat cac cat
     gcc tat tgt taa agt gtg tcc ttt gtc tgg tac agc atg atg gta gtg gta
     ◀────── His 6 ──────                          attB1
                                         ┌─────────────────────────────┐
     His His His Gly Ile  Thr Ser Leu Tyr Lys Lys Ala Gly Phe Glu Asn Leu
1072 cac cat cac ggc atc │aca agt ttg tac aaa aaa gca ggc ttt│gaa aac ctg
     gtg gta gtg ccg tag │tgt tca aac atg ttt ttt cgt ccg aaa│ctt ttg gac
                         └─────────────────────────────┘
                         From pDEST2 ──────▶  ◀────── From PENTR7

TEV protease       ┌─ Start CAT
              ↓         │
     Tyr Phe Gln Gly Thr│Met Gly Lys Lys Ile Thr Gly Tyr Thr Thr Val Asp
1123 tat ttt caa gga acc atg gag aaa aaa atc act gga tat acc acc gtt gat
     ata aaa gtt cct tgg tac ctc ttt ttt tag tga cct ata tgg tgg caa cta
```

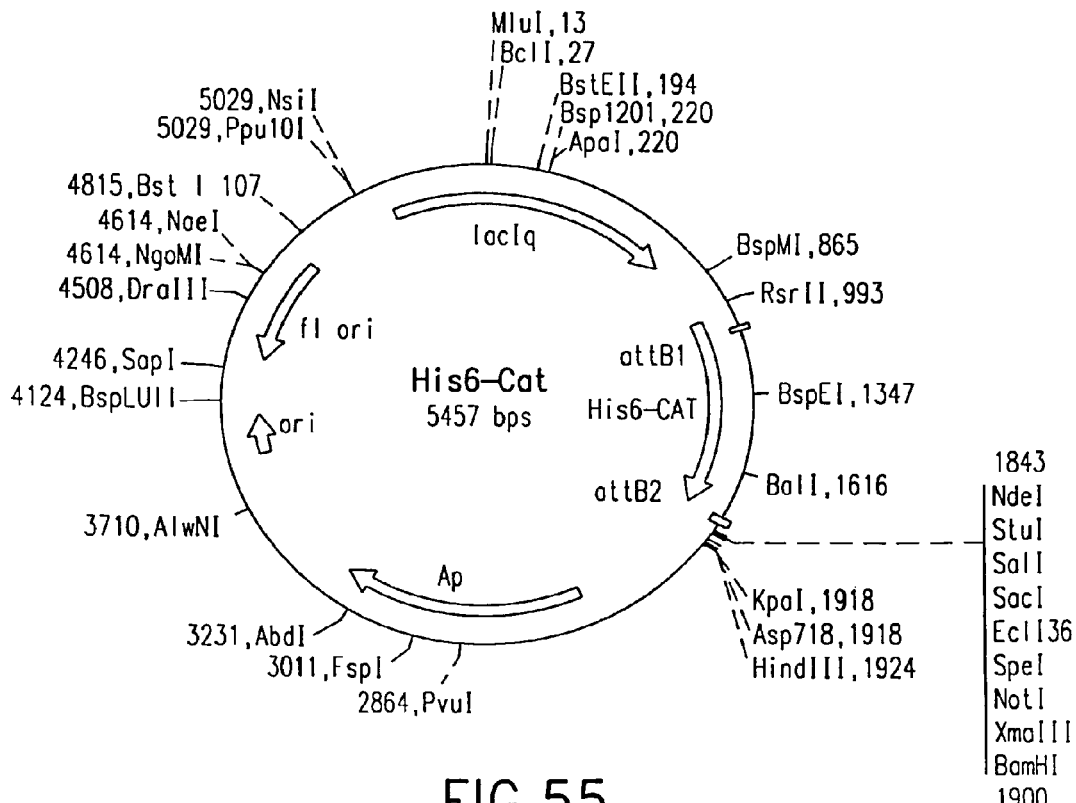

FIG.55

Native Protein Expression:
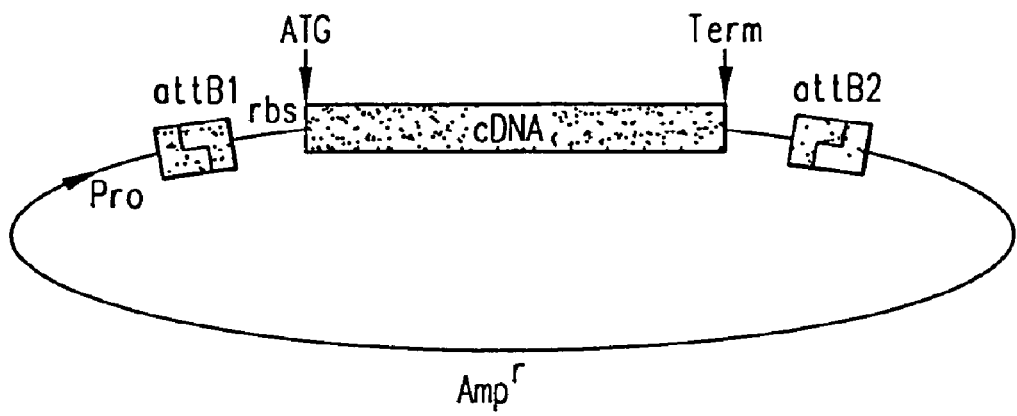
Fusion Protein Expression:
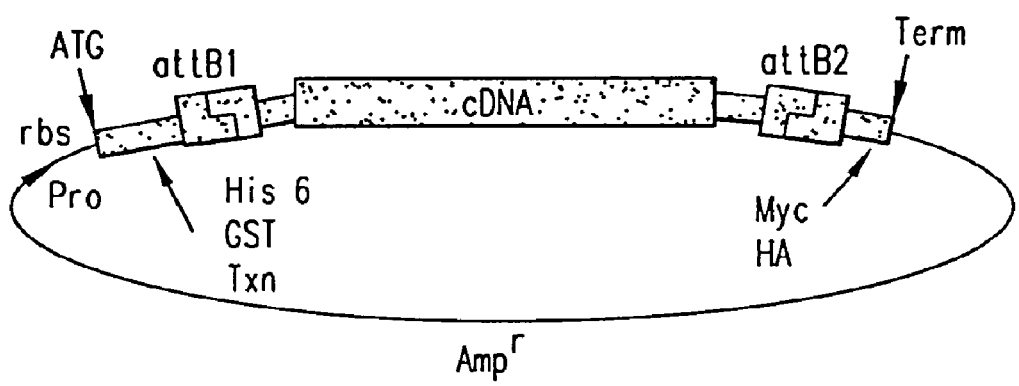
FIG.62

RESULTS OF CLONING
tet AND amp PCR PRODUCTS
BY RECOMBINATION

| PCR PRODUCT USED IN GCS REACTIONS | NO. COLONIES OBTAINED (100 ul PLATED) | FORM OF DNA ANALYZED | COLONIES OBTAINED OF PREDICTED SIZE |
|---|---|---|---|
| tet | 6, 10 | SC | 0 OF 8 |
| attB-tet | 9, 6 | SC | 1 OF 8 |
| attB+4G-tet | 824, 1064 | SC<br>AvaI+Bam | 7 OF 7<br>7 OF 7 |
| amp | 7, 13 | SC | 0 OF 8 |
| attB-amp | 18, 22 | SC | 3 OF 8 |
| attB+4G-amp | 3020, 3540 | SC<br>PstI | 8 OF 8<br>8 OF 8 |
| attB Plasmid (Pos. Control) | 320, 394 | | |

FIG. 66

CLONING OF PCR PRODUCTS OF DIFFERENT SIZES WITH THE GATEWAY™ PCR CLONING SYSTEM

| SIZE | fmols PCR DNA | ng PCR DNA | Cols/ml TRANSFORMATION (pUC=10⁸ CFU/ml) | CORRECT CLONES/TOTAL EXAMINED ** |
|---|---|---|---|---|
| 0.26 kb * | 15<br>37.5 | 3<br>7.5 | 1223<br>2815 | 10/10 (a) |
| 1.0 kb | 15<br>37.5 | 10<br>25 | 507<br>1447 | 49/50 (b) |
| 1.4 kb | 15<br>37.5 | 14<br>35 | 271<br>683 | 48/50 (c) |
| 3.4 kb | 15<br>37.5 | 34<br>85 | 478<br>976 | 9/10 (a) |
| 4.6 kb | 15<br>37.5 | 46<br>115 | 190<br>195 | 10/10 (a) |
| 6.9 kb | 15<br>37.5 | 69<br>173 | 30 (235)<br>54 (463) | 47/50 (b) |

\* THE 0.26 kb PCR PRODUCT WAS USED UNPURIFIED; ALL THE OTHERS WERE PURIFIED BY PRECIPITATION WITH PEG/MgCl₂ AS DESCRIBED IN THE TEXT OF EXAMPLE 9, TO REMOVE PRIMER DIMERS POTENTIALLY PRESENT. STANDARD INCUBATIONS WERE FOR 60

\*\* OVERNIGHT INCUBATION (a) DNA MINIPREPS
(b) ampR/kanR
(c) tetR/kanR

FIG. 77

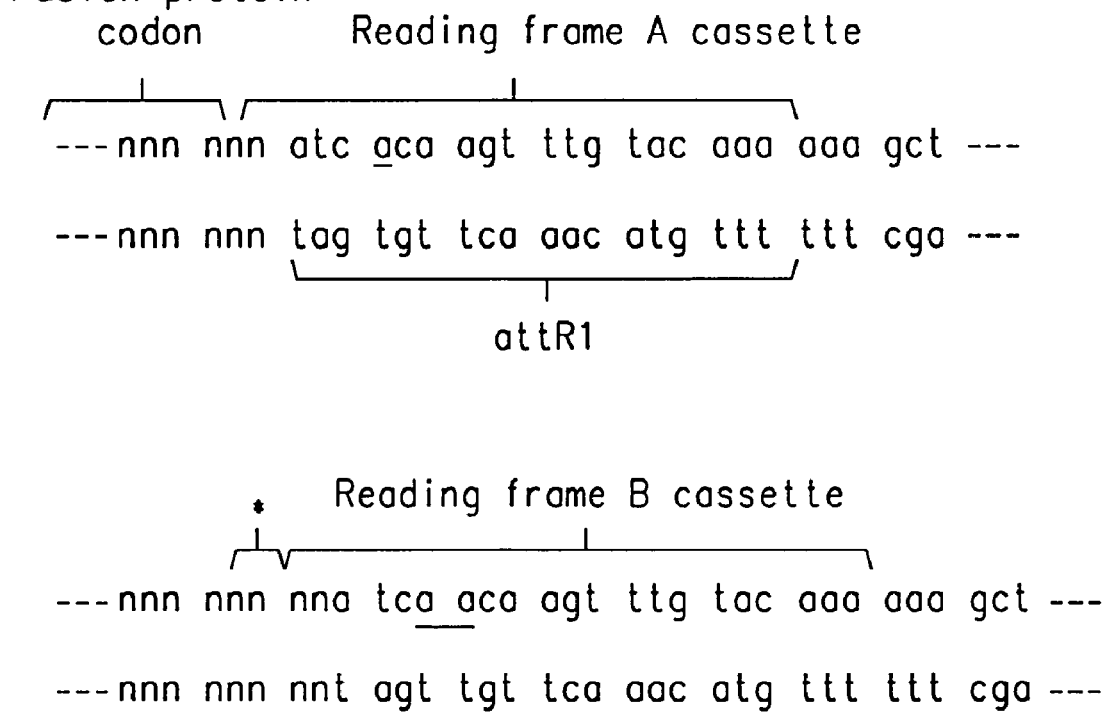
*cannot be TG or TA
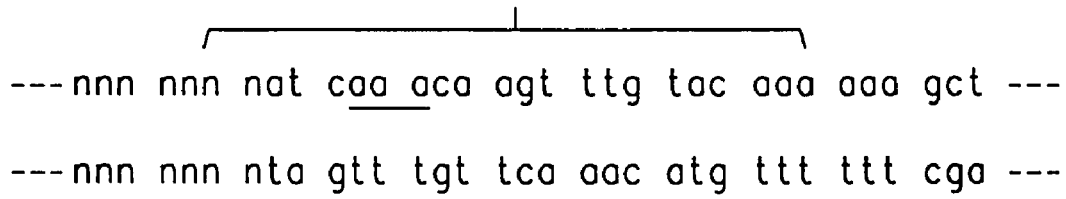
FIG.79 rfB CASSETTE (1713 bps)

prfC Parent III     4554 bp

| Location (Base Nos.) | Gene Encoded |
|---|---|
| 410..286 | attR1 |
| 660..1319 | CmR |
| 1439..1523 | inactivated ccdA |
| 1661..1966 | ccdB |
| 2007..2131 | attR2 |
| 2753..3613 | amp |

```
   1 GCGCCCAATA CGCAAACCGC CTCTCCCCGC GCGTTGGCCG ATTCATTAAT GCAGCTGGCA
  61 CGACAGGTTT CCCGACTGGA AAGCGGGCAG TGAGCGCAAC GCAATTAATG TGAGTTAGCT
 121 CACTCATTAG GCACCCCAGG CTTTACACTT TATGCTTCCG GCTCGTATGT TGTGTGGAAT
 181 TGTGAGCGGA TAACAATTTC ACACAGGAAA CAGCTATGAC CATGATTACG CCAAGCTTGC
 241 ATGCCTGCAG GTCGACTCTA GAGGATCCCC GGGTACCGAT ATCAAACAAG TTTGTACAAA
 301 AAAGCTGAAC GAGAAACGTA AAATGATATA AATATCAATA TATTAAATTA GATTTTGCAT
 361 AAAAAACAGA CTACATAATA CTGTAAAACA CAACATATCC AGTCACTATG GCGGCCGCTA
 421 AGTTGGCAGC ATCACCCGAC GCACTTTGCG CCGAATAAAT ACCTGTGACG GAAGATCACT
 481 TCGCAGAATA AATAAATCCT GGTGTCCCTG TTGATACCGG GAAGCCCTGG GCCAACTTTT
 541 GGCGAAAATG AGACGTTGAT CGGCACGTAA GAGGTTCCAA CTTTCACCAT AATGAAATAA
 601 GATCACTACC GGGCGTATTT TTTGAGTTAT CGAGATTTTC AGGAGCTAAG GAAGCTAAAA
 661 TGGAGAAAAA AATCACTGGA TATACCACCG TTGATATATC CCAATGGCAT CGTAAAGAAC
 721 ATTTTGAGGC ATTTCAGTCA GTTGCTCAAT GTACCTATAA CCAGACCGTT CAGCTGGATA
 781 TTACGGCCTT TTTAAAGACC GTAAAGAAAA ATAAGCACAA GTTTTATCCG GCCTTTATTC
 841 ACATTCTTGC CCGCCTGATG AATGCTCATC CGGAATTCCG TATGGCAATG AAAGACGGTG
 901 AGCTGGTGAT ATGGGATAGT GTTCACCCTT GTTACACCGT TTTCCATGAG CAAACTGAAA
 961 CGTTTTCATC GCTCTGGAGT GAATACCACG ACGATTTCCG GCAGTTTCTA CACATATATT
1021 CGCAAGATGT GGCGTGTTAC GGTGAAAACC TGGCCTATTT CCCTAAAGGG TTTATTGAGA
1081 ATATGTTTTT CGTCTCAGCC AATCCCTGGG TGAGTTTCAC CAGTTTTGAT TTAAACGTGG
1141 CCAATATGGA CAACTTCTTC GCCCCCGTTT TCACCATGGG CAAATATTAT ACGCAAGGCG
1201 ACAAGGTGCT GATGCCGCTG GCGATTCAGG TTCATCATGC CGTCTGTGAT GGCTTCCATG
1261 TCGGCAGAAT GCTTAATGAA TTACAACAGT ACTGCGATGA GTGGCAGGGC GGGGCGTAAT
1321 CTAGAGGATC CGGCTTACTA AAAGCCAGAT AACAGTATGC GTATTTGCGC GCTGATTTTT
1381 GCGGTATAAG AATATATACT GATATGTATA CCCGAAGTAT GTCAAAAAGA GGTGTGCTAT
1441 GAAGCAGCGT ATTACAGTGA CAGTTGACAG CGACAGCTAT CAGTTGCTCA AGGCATATAT
1501 GATGTCAATA TCTCCGGTCT GGTAAGCACA ACCATGCAGA ATGAAGCCCG TCGTCTGCGT
1561 GCCGAACGCT GGAAAGCGGA AAATCAGGAA GGGATGGCTG AGGTCGCCCG GTTTATTGAA
1621 ATGAACGGCT CTTTTGCTGA CGAGAACAGG GACTGGTGAA ATGCAGTTTA AGGTTTACAC
1681 CTATAAAAGA GAGAGCCGTT ATCGTCTGTT TGTGGATGTA CAGAGTGATA TTATTGACAC
1741 GCCCGGGCGA CGGATGGTGA TCCCCCTGGC CAGTGCACGT CTGCTGTCAG ATAAAGTCTC
1801 CCGTGAACTT TACCCGGTGG TGCATATCGG GGATGAAAGC TGGCGCATGA TGACCACCGA
1861 TATGGCCAGT GTGCCGGTCT CCGTTATCGG GGAAGAAGTG GCTGATCTCA GCCACCGCGA
1921 AAATGACATC AAAAACGCCA TTAACCTGAT GTTCTGGGGA ATATAAATGT CAGGCTCCGT
1981 TATACACAGC CAGTCTGCAG GTCGACCATA GTGACTGGAT ATGTTGTGTT TTACAGTATT
2041 ATGTAGTCTG TTTTTTATGC AAAATCTAAT TTAATATATT GATATTTATA TCATTTTACG
```

FIG.83B

```
2101 TTTCTCGTTC AGCTTTCTTG TACAAAGTGG TTCGATATCG GTACCGAGCT CGAATTCACT
2161 GGCCGTCGTT TTACAACGTC GTGACTGGGA AAACCCTGGC GTTACCCAAC TTAATCGCCT
2221 TGCAGCACAT CCCCCTTTCG CCAGCTGGCG TAATAGCGAA GAGGCCCGCA CCGATCGCCC
2281 TTCCCAACAG TTGCGCAGCC TGAATGGCGA ATGGCGCCTG ATGCGGTATT TTCTCCTTAC
2341 GCATCTGTGC GGTATTTCAC ACCGCATATG GTGCACTCTC AGTACAATCT GCTCTGATGC
2401 CGCATAGTTA AGCCAGCCCC GACACCCGCC AACACCCGCT GACGCGCCCT GACGGGCTTG
2461 TCTGCTCCCG GCATCCGCTT ACAGACAAGC TGTGACCGTC TCCGGGAGCT GCATGTGTCA
2521 GAGGTTTTCA CCGTCATCAC CGAAACGCGC GAGACGAAAG GCCTCGTGA TACGCCTATT
2581 TTTATAGGTT AATGTCATGA TAATAATGGT TTCTTAGACG TCAGGTGGCA CTTTTCGGGG
2641 AAATGTGCGC GGAACCCCTA TTTGTTTATT TTTCTAAATA CATTCAAATA TGTATCCGCT
2701 CATGAGACAA TAACCCTGAT AAATGCTTCA ATAATATTGA AAAAGGAAGA GTATGAGTAT
2761 TCAACATTTC CGTGTCGCCC TTATTCCCTT TTTTGCGGCA TTTTGCCTTC CTGTTTTTGC
2821 TCACCCAGAA ACGCTGGTGA AAGTAAAAGA TGCTGAAGAT CAGTTGGGTG CACGAGTGGG
2881 TTACATCGAA CTGGATCTCA ACAGCGGTAA GATCCTTGAG AGTTTTCGCC CCGAAGAACG
2941 TTTTCCAATG ATGAGCACTT TTAAAGTTCT GCTATGTGGC GCGGTATTAT CCCGTATTGA
3001 CGCCGGGCAA GAGCAACTCG GTCGCCGCAT ACACTATTCT CAGAATGACT TGGTTGAGTA
3061 CTCACCAGTC ACAGAAAAGC ATCTTACGGA TGGCATGACA GTAAGAGAAT TATGCAGTGC
3121 TGCCATAACC ATGAGTGATA ACACTGCGGC CAACTTACTT CTGACAACGA TCGGAGGACC
3181 GAAGGAGCTA ACCGCTTTTT TGCACAACAT GGGGGATCAT GTAACTCGCC TTGATCGTTG
3241 GGAACCGGAG CTGAATGAAG CCATACCAAA CGACGAGCGT GACACCACGA TGCCTGTAGC
3301 AATGGCAACA ACGTTGCGCA AACTATTAAC TGGCGAACTA CTTACTCTAG CTTCCCGGCA
3361 ACAATTAATA GACTGGATGG AGGCGGATAA AGTTGCAGGA CCACTTCTGC GCTCGGCCCT
3421 TCCGGCTGGC TGGTTTATTG CTGATAAATC TGGAGCCGGT GAGCGTGGGT CTCGCGGTAT
3481 CATTGCAGCA CTGGGGCCAG ATGGTAAGCC CTCCCGTATC GTAGTTATCT ACACGACGGG
3541 GAGTCAGGCA ACTATGGATG AACGAAATAG ACAGATCGCT GAGATAGGTG CCTCACTGAT
3601 TAAGCATTGG TAACTGTCAG ACCAAGTTTA CTCATATATA CTTTAGATTG ATTTAAAACT
3661 TCATTTTTAA TTTAAAAGGA TCTAGGTGAA GATCCTTTTT GATAATCTCA TGACCAAAAT
3721 CCCTTAACGT GAGTTTTCGT TCCACTGAGC GTCAGACCCC GTAGAAAAGA TCAAAGGATC
3781 TTCTTGAGAT CCTTTTTTTC TGCGCGTAAT CTGCTGCTTG CAAACAAAAA AACCACCGCT
3841 ACCAGCGGTG GTTTGTTTGC CGGATCAAGA GCTACCAACT CTTTTTCCGA AGGTAACTGG
3901 CTTCAGCAGA GCGCAGATAC CAAATACTGT CCTTCTAGTG TAGCCGTAGT TAGGCCACCA
3961 CTTCAAGAAC TCTGTAGCAC CGCCTACATA CCTCGCTCTG CTAATCCTGT TACCAGTGGC
4021 TGCTGCCAGT GGCGATAAGT CGTGTCTTAC CGGGTTGGAC TCAAGACGAT AGTTACCGGA
4081 TAAGGCGCAG CGGTCGGGCT GAACGGGGGG TTCGTGCACA CAGCCCAGCT TGGAGCGAAC
4141 GACCTACACC GAACTGAGAT ACCTACAGCG TGAGCTATGA GAAAGCGCCA CGCTTCCCGA
4201 AGGGAGAAAG GCGGACAGGT ATCCGGTAAG CGGCAGGGTC GGAACAGGAG AGCGCACGAG
4261 GGAGCTTCCA GGGGGAAACG CCTGGTATCT TTATAGTCCT GTCGGGTTTC GCCACCTCTG
4321 ACTTGAGCGT CGATTTTTGT GATGCTCGTC AGGGGGGCGG AGCCTATGGA AAAACGCCAG
4381 CAACGCGGCC TTTTTACGGT TCCTGGCCTT TTGCTGGCCT TTTGCTCACA TGTTCTTTCC
4441 TGCGTTATCC CCTGATTCTG TGGATAACCG TATTACCGCC TTTGAGTGAG CTGATACCGC
4501 TCGCCGCAGC CGAACGACCG AGCGCAGCGA GTCAGTGAGC GAGGAAGCGG AAGA
```

FIG.83C pDEST28 7141 bp

ATGCATGTCGTTACATAACTTACGGTAAATGGCCCGCCTGGCTGACCGCCCAACGACCCC
CGCCCATTGACGTCAATAATGACGTATGTTCCCATAGTAACGCCAATAGGGACTTTCCAT
TGACGTCAATGGGTGGAGTATTTACGGTAAACTGCCCACTTGGCAGTACATCAAGTGTAT
CATATGCCAAGTACGCCCCCTATTGACGTCAATGACGGTAAATGGCCCGCCTGGCATTAT
GCCCAGTACATGACCTTATGGGACTTTCCTACTTGGCAGTACATCTACGTATTAGTCATC
GCTATTACCATGGTGATGCGGTTTTGGCAGTACATCAATGGGCGTGGATAGCGGTTTGAC
TCACGGGGATTTCCAAGTCTCCACCCCATTGACGTCAATGGGAGTTTGTTTTGGCACCAA
AATCAACGGGACTTTCCAAAATGTCGTAACAACTCCGCCCCATTGACGCAAATGGGCGGT
AGGCGTGTACGGTGGGAGGTCTATATAAGCAGAGCTCTCCCTATCAGTGATAGAGATCTC
CCTATCAGTGATAGAGATCGTCGACGAGCTCGTTTAGTGAACCGTCAGATCGCCTGGAGA
CGCCATCCACGCTGTTTTGACCTCCATAGAAGACACCGGGACCGATCCAGCCTCCGGACT
CTAGAGGATCCCTACCGGTGATATCCTCGAGCCCATCAACAAGTTTGTACAAAAAAGCTG
AACGAGAAACGTAAAATGATATAAATATCAATATATTAAATTAGATTTTGCATAAAAAAC
AGACTACATAATACTGTAAAACACAACATATCCAGTCACTATGGCGGCCGCATTAGGCAC
CCCAGGCTTTACACTTTATGCTTCCGGCTCGTATAATGTGTGGATTTTGAGTTAGGATCC
GGCGAGATTTTCAGGAGCTAAGGAAGCTAAAATGGAGAAAAAAATCACTGGATATACCAC
CGTTGATATATCCCAATGGCATCGTAAAGAACATTTTGAGGCATTTCAGTCAGTTGCTCA
ATGTACCTATAACCAGACCGTTCAGCTGGATATTACGGCCTTTTTAAAGACCGTAAAGAA
AAATAAGCACAAGTTTTATCCGGCCTTTATTCACATTCTTGCCCGCCTGATGAATGCTCA
TCCGGAATTCCGTATGGCAATGAAAGACGGTGAGCTGGTGATATGGGATAGTGTTCACCC
TTGTTACACCGTTTTCCATGAGCAAACTGAAACGTTTTCATCGCTCTGGAGTGAATACCA
CGACGATTTCCGGCAGTTTCTACACATATATTCGCAAGATGTGGCGTGTTACGGTGAAAA
CCTGGCCTATTTCCCTAAAGGGTTTATTGAGAATATGTTTTTCGTCTCAGCCAATCCCTG
GGTGAGTTTCACCAGTTTTGATTTAAACGTGGCCAATATGGACAACTTCTTCGCCCCCGT
TTTCACCATGGGCAAATATTATACGCAAGGCGACAAGGTGCTGATGCCGCTGGCGATTCA
GGTTCATCATGCCGTCTGTGATGGCTTCCATGTCGGCAGAATGCTTAATGAATTACAACA
GTACTGCGATGAGTGGCAGGGCGGGGCGTAAAGATCTGGATCCGGCTTACTAAAAGCCAG
ATAACAGTATGCGTATTTGCGCGCTGATTTTTGCGGTATAAGAATATATACTGATATGTA
TACCCGAAGTATGTCAAAAAGAGGTGTGCTATGAAGCAGCGTATTACAGTGACAGTTGAC
AGCGACAGCTATCAGTTGCTCAAGGCATATATGATGTCAATATCTCCGGTCTGGTAAGCA
CAACCATGCAGAATGAAGCCCGTCGTCTGCGTGCCGAACGCTGGAAAGCGGAAAATCAGG
AAGGGATGGCTGAGGTCGCCCGGTTTATTGAAATGAACGGCTCTTTTGCTGACGAGAACA
GGGACTGGTGAAATGCAGTTTAAGGTTTACACCTATAAAAGAGAGAGCCGTTATCGTCTG
TTTGTGGATGTACAGAGTGATATTATTGACACGCCCGGGCGACGGATGGTGATCCCCCTG
GCCAGTGCACGTCTGCTGTCAGATAAAGTCTCCCGTGAACTTTACCCGGTGGTGCATATC
GGGGATGAAAGCTGGCGCATGATGACCACCGATATGGCCAGTGTGCCGGTCTCCGTTATC
GGGGAAGAAGTGGCTGATCTCAGCCACCGCGAAAATGACATCAAAAACGCCATTAACCTG
ATGTTCTGGGGAATATAAATGTCAGGCTCCCTTATACACAGCCAGTCTGCAGGTCGACCA

FIG.90B

TAGTGACTGGATATGTTGTGTTTTACAGTATTATGTAGTCTGTTTTTTATGCAAAATCTA
ATTTAATATATTGATATTTATATCATTTTACGTTTCTCGTTCAGCTTTCTTGTACAAAGT
GGTTGATGGGCGGCCGCTCTAGAGGGCCCAAGCTTACGCGTGCATGCGACGTCATAGCTC
TCTCCCTATAGTGAGTCGTATTATAAGCTAGGCACTGGCCGTCGTTTTACAACGTCGTGA
CTGGGAAAACTGCTAGCTTGGGATCTTTGTGAAGGAACCTTACTTCTGTGGTGTGACATA
ATTGGACAAACTACCTACAGAGATTTAAAGCTCTAAGGTAAATATAAAATTTTTAAGTGT
ATAATGTGTTAAACTAGCTGCATATGCTTGCTGCTTGAGAGTTTTGCTTACTGAGTATGA
TTTATGAAAATATTATACACAGGAGCTAGTGATTCTAATTGTTTGTGTATTTTAGATTCA
CAGTCCCAAGGCTCATTTCAGGCCCCTCAGTCCTCACAGTCTGTTCATGATCATAATCAG
CCATACCACATTTGTAGAGGTTTTACTTGCTTTAAAAAACCTCCCACACCTCCCCCTGAA
CCTGAAACATAAAATGAATGCAATTGTTGTTGTTAACTTGTTTATTGCAGCTTATAATGG
TTACAAATAAAGCAATAGCATCACAAATTTCACAAATAAAGCATTTTTTTCACTGCATTC
TAGTTGTGGTTTGTCCAAACTCATCAATGTATCTTATCATGTCTGGATCGATCCTGCATT
AATGAATCGGCCAACGCGCGGGGAGAGGCGGTTTGCGTATTGGCTGGCGTAATAGCGAAG
AGGCCCGCACCGATCGCCCTTCCCAACAGTTGCGCAGCCTGAATGGCGAATGGGACGCGC
CCTGTAGCGGCGCATTAAGCGCGGCGGGTGTGGTGGTTACGCGCAGCGTGACCGCTACAC
TTGCCAGCGCCCTAGCGCCCGCTCCTTTCGCTTTCTTCCCTTCCTTTCTCGCCACGTTCG
CCGGCTTTCCCCGTCAAGCTCTAAATCGGGGGCTCCCTTTAGGGTTCCGATTTAGTGCTT
TACGGCACCTCGACCCCAAAAAACTTGATTAGGGTGATGGTTCACGTAGTGGGCCATCGC
CCTGATAGACGGTTTTTCGCCCTTTGACGTTGGAGTCCACGTTCTTTAATAGTGGACTCT
TGTTCCAAACTGGAACAACACTCAACCCTATCTCGGTCTATTCTTTTGATTTATAAGGGA
TTTTGCCGATTTCGGCCTATTGGTTAAAAAATGAGCTGATTTAACAAATATTTAACGCGA
ATTTTAACAAAATATTAACGTTTACAATTTCGCCTGATGCGGTATTTTCTCCTTACGCAT
CTGTGCGGTATTTCACACCGCATACGCGGATCTGCGCAGCACCATGGCCTGAAATAACCT
CTGAAAGAGGAACTTGGTTAGGTACCTTCTGAGGCGGAAAGAACCAGCTGTGGAATGTGT
GTCAGTTAGGGTGTGGAAAGTCCCCAGGCTCCCCAGCAGGCAGAAGTATGCAAAGCATGC
ATCTCAATTAGTCAGCAACCAGGTGTGGAAAGTCCCCAGGCTCCCCAGCAGGCAGAAGTA
TGCAAAGCATGCATCTCAATTAGTCAGCAACCATAGTCCCGCCCCTAACTCCGCCCATCC
CGCCCCTAACTCCGCCCAGTTCCGCCCATTCTCCGCCCCATGGCTGACTAATTTTTTTTA
TTTATGCAGAGGCCGAGGCCGCCTCGGCCTCTGAGCTATTCCAGAAGTAGTGAGGAGGCT
TTTTTGGAGGCCTAGGCTTTTGCAAAAAGCTTGATTCTTCTGACACAACAGTCTCGAACT
TAAGACCATGGCCAAGCCTTTGTCTCAAGAAGAATCCACCCTCATTGAAAGAGCAACGGC
TACAATCAACAGCATCCCCATCTCTGAAGACTACAGCGTCGCCAGCGCAGCTCTCTCTAG
CGACGGCCGCATCTTCACTGGTGTCAATGTATATCATTTTACTGGGGGACCTTGTGCAGA
ACTCGTGGTGCTGGGCACTGCTGCTGCTGCGGCAGCTGGCAACCTGACTTGTATCGTCGC
GATCGGAAATGAGAACAGGGGCATCTTGAGCCCCTGCGGACGGTGCCGACAGGTGCTTCT
CGATCTGCATCCTGGGATCAAAGCCATAGTGAAGGACAGTGATGGACAGCCGACGGCAGT
TGGGATTCGTGAATTGCTGCCCTCTGGTTATGTGTGGGAGGGCTAAGCACTTCGTGGCCG
AGTTCGAAATGACCGACCAAGCGACGCCCAACCTGCCATCACGATGGCCGCAATAAAATA
TCTTTATTTTCATTACATCTGTGTGTTGGTTTTTTGTGTGAATCGATAGCGATAAGGATC
CGCGTATGGTGCACTCTCAGTACAATCTGCTCTGATGCCGCATAGTTAAGCCAGCCCCGA

FIG.90C

```
CACCCGCCAACACCCGCTGACGCGCCCTGACGGGCTTGTCTGCTCCCGGCATCCGCTTAC
AGACAAGCTGTGACCGTCTCCGGGAGCTGCATGTGTCAGAGGTTTTCACCGTCATCACCG
AAACGCGCGAGACGAAAGGGCCTCGTGATACGCCTATTTTTATAGGTTAATGTCATGATA
ATAATGGTTTCTTAGACGTCAGGTGGCACTTTTCGGGGAAATGTGCGCGGAACCCCTATT
TGTTTATTTTTCTAAATACATTCAAATATGTATCCGCTCATGAGACAATAACCCTGATAA
ATGCTTCAATAATATTGAAAAAGGAAGAGTATGAGTATTCAACATTTCCGTGTCGCCCTT
ATTCCCTTTTTTGCGGCATTTTGCCTTCCTGTTTTTGCTCACCCAGAAACGCTGGTGAAA
GTAAAAGATGCTGAAGATCAGTTGGGTGCACGAGTGGGTTACATCGAACTGGATCTCAAC
AGCGGTAAGATCCTTGAGAGTTTTCGCCCCGAAGAACGTTTTCCAATGATGAGCACTTTT
AAAGTTCTGCTATGTGGCGCGGTATTATCCCGTATTGACGCCGGGCAAGAGCAACTCGGT
CGCCGCATACACTATTCTCAGAATGACTTGGTTGAGTACTCACCAGTCACAGAAAAGCAT
CTTACGGATGGCATGACAGTAAGAGAATTATGCAGTGCTGCCATAACCATGAGTGATAAC
ACTGCGGCCAACTTACTTCTGACAACGATCGGAGGACCGAAGGAGCTAACCGCTTTTTTG
CACAACATGGGGGATCATGTAACTCGCCTTGATCGTTGGGAACCGGAGCTGAATGAAGCC
ATACCAAACGACGAGCGTGACACCACGATGCCTGTAGCAATGGCAACAACGTTGCGCAAA
CTATTAACTGGCGAACTACTTACTCTAGCTTCCCGGCAACAATTAATAGACTGGATGGAG
GCGGATAAAGTTGCAGGACCACTTCTGCGCTCGGCCCTTCCGGCTGGCTGGTTTATTGCT
GATAAATCTGGAGCCGGTGAGCGTGGGTCTCGCGGTATCATTGCAGCACTGGGGCCAGAT
GGTAAGCCCTCCCGTATCGTAGTTATCTACACGACGGGGAGTCAGGCAACTATGGATGAA
CGAAATAGACAGATCGCTGAGATAGGTGCCTCACTGATTAAGCATTGGTAACTGTCAGAC
CAAGTTTACTCATATATACTTTAGATTGATTTAAAACTTCATTTTTAATTTAAAAGGATC
TAGGTGAAGATCCTTTTTGATAATCTCATGACCAAAATCCCTTAACGTGAGTTTTCGTTC
CACTGAGCGTCAGACCCCGTAGAAAAGATCAAAGGATCTTCTTGAGATCCTTTTTTTCTG
CGCGTAATCTGCTGCTTGCAAACAAAAAAACCACCGCTACCAGCGGTGGTTTGTTTGCCG
GATCAAGAGCTACCAACTCTTTTTCCGAAGGTAACTGGCTTCAGCAGAGCGCAGATACCA
AATACTGTCCTTCTAGTGTAGCCGTAGTTAGGCCACCACTTCAAGAACTCTGTAGCACCG
CCTACATACCTCGCTCTGCTAATCCTGTTACCAGTGGCTGCTGCCAGTGGCGATAAGTCG
TGTCTTACCGGGTTGGACTCAAGACGATAGTTACCGGATAAGGCGCAGCGGTCGGGCTGA
ACGGGGGGTTCGTGCACACAGCCCAGCTTGGAGCGAACGACCTACACCGAACTGAGATAC
CTACAGCGTGAGCATTGAGAAAGCGCCACGCTTCCCGAAGGGAGAAAGGCGGACAGGTAT
CCGGTAAGCGGCAGGGTCGGAACAGGAGAGCGCACGAGGGAGCTTCCAGGGGGAAACGCC
TGGTATCTTTATAGTCCTGTCGGGTTTCGCCACCTCTGACTTGAGCGTCGATTTTTGTGA
TGCTCGTCAGGGGGCGGAGCCTATGGAAAAACGCCAGCAACGCGGCCTTTTTACGGTTC
CTGGCCTTTTGCTGGCCTTTTGCTCACATGTTCTTTCCTGCGTTATCCCCTGATTCTGTG
GATAACCGTATTACCGCCTTTGAGTGAGCTGATACCGCTCGCCGCAGCCGAACGACCGAG
CGCAGCGAGTCAGTGAGCGAGGAAGCGGAAGAGCGCCCAATACGCAAACCGCCTCTCCCC
GCGCGTTGGCCGATTCATTAATGCAGAGCTTGCAATTCGCGCGTTTTTCAATATTATTGA
AGCATTTATCAGGGTTATTGTCTCATGAGCGGATACATATTTGAATGTATTTAGAAAAAT
AAACAAATAGGGGTTCCGCGCACATTTCCCCGAAAAGTGCCACCTGACGTCTAAGAAACC
ATTATTATCATGACATTAACCTATAAAAATAGGCGTAGTACGAGGCCCTTTCACTCATTA
G
```

FIG.90D pDEST29 7156 bp

ATGCATGTCGTTACATAACTTACGGTAAATGGCCCGCCTGGCTGACCGCCCAACGACCCC
CGCCCATTGACGTCAATAATGACGTATGTTCCCATAGTAACGCCAATAGGGACTTTCCAT
TGACGTCAATGGGTGGAGTATTTACGGTAAACTGCCCACTTGGCAGTACATCAAGTGTAT
CATATGCCAAGTACGCCCCCTATTGACGTCAATGACGGTAAATGGCCCGCCTGGCATTAT
GCCCAGTACATGACCTTATGGGACTTTCCTACTTGGCAGTACATCTACGTATTAGTCATC
GCTATTACCATGGTGATGCGGTTTTGGCAGTACATCAATGGGCGTGGATAGCGGTTTGAC
TCACGGGGATTTCCAAGTCTCCACCCCATTGACGTCAATGGGAGTTTGTTTTGGCACCAA
AATCAACGGGACTTTCCAAAATGTCGTAACAACTCCGCCCCATTGACGCAAATGGGCGGT
AGGCGTGTACGGTGGGAGGTCTATATAAGCAGAGCTCTCCCTATCAGTGATAGAGATCTC
CCTATCAGTGATAGAGATCGTCGACGAGCTCGTTTAGTGAACCGTCAGATCGCCTGGAGA
CGCCATCCACGCTGTTTTGACCTCCATAGAAGACACCGGGACCGATCCAGCCTCCGGACC
ATGGCGTACTACCATCACCATCACCATCACACCGGTGATATCCTCGAGCCCATCACAAGT
TTGTACAAAAAAGCTGAACGAGAAACGTAAAATGATATAAATATCAATATATTAAATTAG
ATTTTGCATAAAAAACAGACTACATAATACTGTAAAACACAACATATCCAGTCACTATGG
CGGCCGCATTAGGCACCCCAGGCTTTACACTTTATGCTTCCGGCTCGTATAATGTGTGGA
TTTTGAGTTAGGATCCGGCGAGATTTTCAGGAGCTAAGGAAGCTAAAATGGAGAAAAAAA
TCACTGGATATACCACCGTTGATATATCCCAATGGCATCGTAAAGAACATTTTGAGGCAT
TTCAGTCAGTTGCTCAATGTACCTATAACCAGACCGTTCAGCTGGATATTACGGCCTTTT
TAAAGACCGTAAAGAAAAATAAGCACAAGTTTTATCCGGCCTTTATTCACATTCTTGCCC
GCCTGATGAATGCTCATCCGGAATTCCGTATGGCAATGAAAGACGGTGAGCTGGTGATAT
GGGATAGTGTTCACCCTTGTTACACCGTTTTCCATGAGCAAACTGAAACGTTTTCATCGC
TCTGGAGTGAATACCACGACGATTTCCGGCAGTTTCTACACATATATTCGCAAGATGTGG
CGTGTTACGGTGAAAACCTGGCCTATTTCCCTAAAGGGTTTATTGAGAATATGTTTTTCG
TCTCAGCCAATCCCTGGGTGAGTTTCACCAGTTTTGATTTAAACGTGGCCAATATGGACA
ACTTCTTCGCCCCCGTTTTCACCATGGGCAAATATTATACGCAAGGCGACAAGGTGCTGA
TGCCGCTGGCGATTCAGGTTCATCATGCCGTCTGTGATGGCTTCCATGTCGGCAGAATGC
TTAATGAATTACAACAGTACTGCGATGAGTGGCAGGGCGGGGCGTAAACGCGTGGATCCG
GCTTACTAAAAGCCAGATAACAGTATGCGTATTTGCGCGCTGATTTTTGCGGTATAAGAA
TATATACTGATATGTATACCCGAAGTATGTCAAAAAGAGGTGTGCTATGAAGCAGCGTAT
TACAGTGACAGTTGACAGCGACAGCTATCAGTTGCTCAAGGCATATATGATGTCAATATC
TCCGGTCTGGTAAGCACAACCATGCAGAATGAAGCCCGTCGTCTGCGTGCCGAACGCTGG
AAAGCGGAAAATCAGGAAGGGATGGCTGAGGTCGCCCGGTTTATTGAAATGAACGGCTCT
TTTGCTGACGAGAACAGGGACTGGTGAAATGCAGTTTAAGGTTTACACCTATAAAAGAGA
GAGCCGTTATCGTCTGTTTGTGGATGTACAGAGTGATATTATTGACACGCCCGGGCGACG
GATGGTGATCCCCCTGGCCAGTGCACGTCTGCTGTCAGATAAAGTCTCCCGTGAACTTTA
CCCGGTGGTGCATATCGGGGATGAAAGCTGGCGCATGATGACCACCGATATGGCCAGTGT
GCCGGTCTCCGTTATCGGGGAAGAAGTGGCTGATCTCAGCCACCGCGAAAATGACATCAA
AAACGCCATTAACCTGATGTTCTGGGGAATATAAATGTCAGGCTCCGTTATACACAGCCA

FIG.91B

```
GTCTGCAGGTCGACCATAGTGACTGGATATGTTGTGTTTACAGTATTATGTAGTCTGTT
TTTTATGCAAAATCTAATTTAATATATTGATATTTATATCATTTTACGTTTCTCGTTCAG
CTTTCTTGTACAAAGTGGTGATGGGCGGCCGCTCTAGAGGGCCCAAGCTTACGCGTGCAT
GCGACGTCATAGCTCTCTCCCTATAGTGAGTCGTATTATAAGCTAGGCACTGGCCGTCGT
TTTACAACGTCGTGACTGGGAAAACTGCTAGCTTGGGATCTTTGTGAAGGAACCTTACTT
CTGTGGTGTGACATAATTGGACAAACTACCTACAGAGATTTAAAGCTCTAAGGTAAATAT
AAAATTTTTAAGTGTATAATGTGTTAAACTAGCTGCATATGCTTGCTGCTTGAGAGTTTT
GCTTACTGAGTATGATTTATGAAAATATTATACACAGGAGCTAGTGATTCTAATTGTTTG
TGTATTTTAGATTCACAGTCCCAAGGCTCATTTCAGGCCCCTCAGTCCTCACAGTCTGTT
CATGATCATAATCAGCCATACCACATTTGTAGAGGTTTTACTTGCTTTAAAAAACCTCCC
ACACCTCCCCCTGAACCTGAAACATAAAATGAATGCAATTGTTGTTGTTAACTTGTTTAT
TGCAGCTTATAATGGTTACAAATAAAGCAATAGCATCACAAATTTCACAAATAAAGCATT
TTTTTCACTGCATTCTAGTTGTGGTTTGTCCAAACTCATCAATGTATCTTATCATGTCTG
GATCGATCCTGCATTAATGAATCGGCCAACGCGCGGGGAGAGGCGGTTTGCGTATTGGCT
GGCGTAATAGCGAAGAGGCCCGCACCGATCGCCCTTCCCAACAGTTGCGCAGCCTGAATG
GCGAATGGGACGCGCCCTGTAGCGGCGCATTAAGCGCGGCGGGTGTGGTGGTTACGCGCA
GCGTGACCGCTACACTTGCCAGCGCCCTAGCGCCCGCTCCTTTCGCTTTCTTCCCTTCCT
TTCTCGCCACGTTCGCCGGCTTTCCCCGTCAAGCTCTAAATCGGGGGCTCCCTTTAGGGT
TCCGATTTAGTGCTTTACGGCACCTCGACCCCAAAAAACTTGATTAGGGTGATGGTTCAC
GTAGTGGGCCATCGCCCTGATAGACGGTTTTTCGCCCTTTGACGTTGGAGTCCACGTTCT
TTAATAGTGGACTCTTGTTCCAAACTGGAACAACACTCAACCCTATCTCGGTCTATTCTT
TTGATTTATAAGGGATTTTGCCGATTTCGGCCTATTGGTTAAAAAATGAGCTGATTTAAC
AAATATTTAACGCGAATTTTAACAAAATATTAACGTTTACAATTTCGCCTGATGCGGTAT
TTTCTCCTTACGCATCTGTGCGGTATTTCACACCGCATACGCGGATCTGCGCAGCACCAT
GGCCTGAAATAACCTCTGAAAGAGGAACTTGGTTAGGTACCTTCTGAGGCGGAAAGAACC
AGCTGTGGAATGTGTGTCAGTTAGGGTGTGGAAAGTCCCCAGGCTCCCCAGCAGGCAGAA
GTATGCAAAGCATGCATCTCAATTAGTCAGCAACCAGGTGTGGAAAGTCCCCAGGCTCCC
CAGCAGGCAGAAGTATGCAAAGCATGCATCTCAATTAGTCAGCAACCATAGTCCCGCCCC
TAACTCCGCCCATCCCGCCCCTAACTCCGCCCAGTTCCGCCCATTCTCCGCCCCATGGCT
GACTAATTTTTTTTATTTATGCAGAGGCCGAGGCCGCCTCGGCCTCTGAGCTATTCCAGA
AGTAGTGAGGAGGCTTTTTTGGAGGCCTAGGCTTTTGCAAAAAGCTTGATTCTTCTGACA
CAACAGTCTCGAACTTAAGACCATGGCCAAGCCTTTGTCTCAAGAAGAATCCACCCTCAT
TGAAAGAGCAACGGCTACAATCAACAGCATCCCCATCTCTGAAGACTACAGCGTCGCCAG
CGCAGCTCTCTCTAGCGACGGCCGCATCTTCACTGGTGTCAATGTATATCATTTTACTGG
GGGACCTTGTGCAGAACTCGTGGTGCTGGGCACTGCTGCTGCTGCGGCAGCTGGCAACCT
GACTTGTATCGTCGCGATCGGAAATGAGAACAGGGGCATCTTGAGCCCCTGCGGACGGTG
CCGACAGGTGCTTCTCGATCTGCATCCTGGGATCAAAGCCATAGTGAAGGACAGTGATGG
ACAGCCGACGGCAGTTGGGATTCGTGAATTGCTGCCCTCTGGTTATGTGTGGGAGGGCTA
AGCACTTCGTGGCCGAGTTCGAAATGACCGACCAAGCGACGCCCAACCTGCCATCACGAT
GGCCGCAATAAAATATCTTTATTTTCATTACATCTGTGTGTTGGTTTTTTGTGTGAATCG
ATAGCGATAAGGATCCGCGTATGGTGCACTCTCAGTACAATCTGCTCTGATGCCGCATAG
```

FIG.91C

```
TTAAGCCAGCCCCGACACCCGCCAACACCCGCTGACGCGCCCTGACGGGCTTGTCTGCTC
CCGGCATCCGCTTACAGACAAGCTGTGACCGTCTCCGGGAGCTGCATGTGTCAGAGGTTT
TCACCGTCATCACCGAAACGCGCGAGACGAAAGGGCCTCGTGATACGCCTATTTTTATAG
GTTAATGTCATGATAATAATGGTTTCTTAGACGTCAGGTGGCACTTTTCGGGGAAATGTG
CGCGGAACCCCTATTTGTTTATTTTTCTAAATACATTCAAATATGTATCCGCTCATGAGA
CAATAACCCTGATAAATGCTTCAATAATATTGAAAAAGGAAGAGTATGAGTATTCAACAT
TTCCGTGTCGCCCTTATTCCCTTTTTTGCGGCATTTTGCCTTCCTGTTTTTGCTCACCCA
GAAACGCTGGTGAAAGTAAAAGATGCTGAAGATCAGTTGGGTGCACGAGTGGGTTACATC
GAACTGGATCTCAACAGCGGTAAGATCCTTGAGAGTTTTCGCCCCGAAGAACGTTTTCCA
ATGATGAGCACTTTTAAAGTTCTGCTATGTGGCGCGGTATTATCCCGTATTGACGCCGGG
CAAGAGCAACTCGGTCGCCGCATACACTATTCTCAGAATGACTTGGTTGAGTACTCACCA
GTCACAGAAAAGCATCTTACGGATGGCATGACAGTAAGAGAATTATGCAGTGCTGCCATA
ACCATGAGTGATAACACTGCGGCCAACTTACTTCTGACAACGATCGGAGGACCGAAGGAG
CTAACCGCTTTTTTGCACAACATGGGGGATCATGTAACTCGCCTTGATCGTTGGGAACCG
GAGCTGAATGAAGCCATACCAAACGACGAGCGTGACACCACGATGCCTGTAGCAATGGCA
ACAACGTTGCGCAAACTATTAACTGGCGAACTACTTACTCTAGCTTCCCGGCAACAATTA
ATAGACTGGATGGAGGCGGATAAAGTTGCAGGACCACTTCTGCGCTCGGCCCTTCCGGCT
GGCTGGTTTATTGCTGATAAATCTGGAGCCGGTGAGCGTGGGTCTCGCGGTATCATTGCA
GCACTGGGGCCAGATGGTAAGCCCTCCCGTATCGTAGTTATCTACACGACGGGGAGTCAG
GCAACTATGGATGAACGAAATAGACAGATCGCTGAGATAGGTGCCTCACTGATTAAGCAT
TGGTAACTGTCAGACCAAGTTTACTCATATATACTTTAGATTGATTTAAAACTTCATTTT
TAATTTAAAAGGATCTAGGTGAAGATCCTTTTTGATAATCTCATGACCAAAATCCCTTAA
CGTGAGTTTTCGTTCCACTGAGCGTCAGACCCCGTAGAAAAGATCAAAGGATCTTCTTGA
GATCCTTTTTTTCTGCGCGTAATCTGCTGCTTGCAAACAAAAAAACCACCGCTACCAGCG
GTGGTTTGTTTGCCGGATCAAGAGCTACCAACTCTTTTTCCGAAGGTAACTGGCTTCAGC
AGAGCGCAGATACCAAATACTGTCCTTCTAGTGTAGCCGTAGTTAGGCCACCACTTCAAG
AACTCTGTAGCACCGCCTACATACCTCGCTCTGCTAATCCTGTTACCAGTGGCTGCTGCC
AGTGGCGATAAGTCGTGTCTTACCGGGTTGGACTCAAGACGATAGTTACCGGATAAGGCG
CAGCGGTCGGGCTGAACGGGGGGTTCGTGCACACAGCCCAGCTTGGAGCGAACGACCTAC
ACCGAACTGAGATACCTACAGCGTGAGCATTGAGAAAGCGCCACGCTTCCCGAAGGGAGA
AAGGCGGACAGGTATCCGGTAAGCGGCAGGGTCGGAACAGGAGAGCGCACGAGGGAGCTT
CCAGGGGGAAACGCCTGGTATCTTTATAGTCCTGTCGGGTTTCGCCACCTCTGACTTGAG
CGTCGATTTTTGTGATGCTCGTCAGGGGGCGGAGCCTATGGAAAAACGCCAGCAACGCG
GCCTTTTTACGGTTCCTGGCCTTTTGCTGGCCTTTTGCTCACATGTTCTTTCCTGCGTTA
TCCCCTGATTCTGTGGATAACCGTATTACCGCCTTTGAGTGAGCTGATACCGCTCGCCGC
AGCCGAACGACCGAGCGCAGCGAGTCAGTGAGCGAGGAAGCGGAAGAGCGCCCAATACGC
AAACCGCCTCTCCCCGCGCGTTGGCCGATTCATTAATGCAGAGCTTGCAATTCGCGCGTT
TTTCAATATTATTGAAGCATTTATCAGGGTTATTGTCTCATGAGCGGATACATATTTGAA
TGTATTTAGAAAAATAAACAAATAGGGGTTCCGCGCACATTTCCCCGAAAAGTGCCACCT
GACGTCTAAGAAACCATTATTATCATGACATTAACCTATAAAAATAGGCGTAGTACGAGG
CCCTTTCACTCATTAG
```

FIG. 91D pDEST30 7544 bp

ATGCATGTCGTTACATAACTTACGGTAAATGGCCCGCCTGGCTGACCGCCCAACGACCCC
CGCCCATTGACGTCAATAATGACGTATGTTCCCATAGTAACGCCAATAGGGACTTTCCAT
TGACGTCAATGGGTGGAGTATTTACGGTAAACTGCCCACTTGGCAGTACATCAAGTGTAT
CATATGCCAAGTACGCCCCCTATTGACGTCAATGACGGTAAATGGCCCGCCTGGCATTAT
GCCCAGTACATGACCTTATGGGACTTTCCTACTTGGCAGTACATCTACGTATTAGTCATC
GCTATTACCATGGTGATGCGGTTTTGGCAGTACATCAATGGGCGTGGATAGCGGTTTGAC
TCACGGGGATTTCCAAGTCTCCACCCCATTGACGTCAATGGGAGTTTGTTTTGGCACCAA
AATCAACGGGACTTTCCAAAATGTCGTAACAACTCCGCCCCATTGACGCAAATGGGCGGT
AGGCGTGTACGGTGGGAGGTCTATATAAGCAGAGCTCTCCCTATCAGTGATAGAGATCTC
CCTATCAGTGATAGAGATCGTCGACGAGCTCGTTTAGTGAACCGTCAGATCGCCTGGAGA
CGCCATCCACGCTGTTTTGACCTCCATAGAAGACACCGGGACCGATCCAGCCTCCGGACT
CTAGAGGATCCCTACCGGTGATATCCTCGAGCCCATCAACAAGTTTGTACAAAAAAGCTG
AACGAGAAACGTAAAATGATATAAATATCAATATATTAAATTAGATTTTGCATAAAAAAC
AGACTACATAATACTGTAAAACACAACATATCCAGTCACTATGGCGGCCGCATTAGGCAC
CCCAGGCTTTACACTTTATGCTTCCGGCTCGTATAATGTGTGGATTTTGAGTTAGGATCC
GGCGAGATTTTCAGGAGCTAAGGAAGCTAAAATGGAGAAAAAAATCACTGGATATACCAC
CGTTGATATATCCCAATGGCATCGTAAAGAACATTTTGAGGCATTTCAGTCAGTTGCTCA
ATGTACCTATAACCAGACCGTTCAGCTGGATATTACGGCCTTTTTAAAGACCGTAAAGAA
AAATAAGCACAAGTTTTATCCGGCCTTTATTCACATTCTTGCCCGCCTGATGAATGCTCA
TCCGGAATTCCGTATGGCAATGAAAGACGGTGAGCTGGTGATATGGGATAGTGTTCACCC
TTGTTACACCGTTTTCCATGAGCAAACTGAAACGTTTTCATCGCTCTGGAGTGAATACCA
CGACGATTTCCGGCAGTTTCTACACATATATTCGCAAGATGTGGCGTGTTACGGTGAAAA
CCTGGCCTATTTCCCTAAAGGGTTTATTGAGAATATGTTTTTCGTCTCAGCCAATCCCTG
GGTGAGTTTCACCAGTTTTGATTTAAACGTGGCCAATATGGACAACTTCTTCGCCCCCGT
TTTCACCATGGGCAAATATTATACGCAAGGCGACAAGGTGCTGATGCCGCTGGCGATTCA
GGTTCATCATGCCGTCTGTGATGGCTTCCATGTCGGCAGAATGCTTAATGAATTACAACA
GTACTGCGATGAGTGGCAGGGCGGGGCGTAAAGATCTGGATCCGGCTTACTAAAAGCCAG
ATAACAGTATGCGTATTTGCGCGCTGATTTTTGCGGTATAAGAATATATACTGATATGTA
TACCCGAAGTATGTCAAAAAGAGGTGTGCTATGAAGCAGCGTATTACAGTGACAGTTGAC
AGCGACAGCTATCAGTTGCTCAAGGCATATATGATGTCAATATCTCCGGTCTGGTAAGÇA
CAACCATGCAGAATGAAGCCCGTCGTCTGCGTGCCGAACGCTGGAAAGCGGAAAATCAGG
AAGGGATGGCTGAGGTCGCCCGGTTTATTGAAATGAACGGCTCTTTTGCTGACGAGAACA
GGGACTGGTGAAATGCAGTTTAAGGTTTACACCTATAAAAGAGAGAGCCGTTATCGTCTG
TTTGTGGATGTACAGAGTGATATTATTGACACGCCCGGGCGACGGATGGTGATCCCCCTG
GCCAGTGCACGTCTGCTGTCAGATAAAGTCTCCCGTGAACTTTACCCGGTGGTGCATATC
GGGGATGAAAGCTGGCGCATGATGACCACCGATATGGCCAGTGTGCCGGTCTCCGTTATC
GGGGAAGAAGTGGCTGATCTCAGCCACCGCGAAAATGACATCAAAAACGCCATTAACCTG
ATGTTCTGGGGAATATAAATGTCAGGCTCCCTTATACACAGCCAGTCTGCAGGTCGACCA
TAGTGACTGGATATGTTGTGTTTTACAGTATTATGTAGTCTGTTTTTTATGCAAAATCTA
ATTTAATATATTGATATTTATATCATTTTACGTTTCTCGTTCAGCTTTCTTGTACAAAGT
GGTTGATGGGCGGCCGCTCTAGAGGGCCCAAGCTTACGCGTGCATGCGACGTCATAGCTC
TCTCCCTATAGTGAGTCGTATTATAAGCTAGGCACTGGCCGTCGTTTTACAACGTCGTGA
CTGGGAAAACTGCTAGCTTGGGATCTTTGTGAAGGAACCTTACTTCTGTGGTGTGACATA

FIG.92B

```
ATTGGACAAACTACCTACAGAGATTTAAAGCTCTAAGGTAAATATAAAATTTTTAAGTGT
ATAATGTGTTAAACTAGCTGCATATGCTTGCTGCTTGAGAGTTTTGCTTACTGAGTATGA
TTTATGAAAATATTATACACAGGAGCTAGTGATTCTAATTGTTTGTGTATTTTAGATTCA
CAGTCCCAAGGCTCATTTCAGGCCCCTCAGTCCTCACAGTCTGTTCATGATCATAATCAG
CCATACCACATTTGTAGAGGTTTTACTTGCTTTAAAAAACCTCCCACACCTCCCCCTGAA
CCTGAAACATAAAATGAATGCAATTGTTGTTGTTAACTTGTTTATTGCAGCTTATAATGG
TTACAAATAAAGCAATAGCATCACAAATTTCACAAATAAAGCATTTTTTTCACTGCATTC
TAGTTGTGGTTTGTCCAAACTCATCAATGTATCTTATCATGTCTGGATCGATCCTGCATT
AATGAATCGGCCAACGCGCGGGGAGAGGCGGTTTGCGTATTGGCTGGCGTAATAGCGAAG
AGGCCCGCACCGATCGCCCTTCCCAACAGTTGCGCAGCCTGAATGGCGAATGGGACGCGC
CCTGTAGCGGCGCATTAAGCGCGGCGGGTGTGGTGGTTACGCGCAGCGTGACCGCTACAC
TTGCCAGCGCCCTAGCGCCCGCTCCTTTCGCTTTCTTCCCTTCCTTTCTCGCCACGTTCG
CCGGCTTTCCCCGTCAAGCTCTAAATCGGGGGCTCCCTTTAGGGTTCCGATTTAGTGCTT
TACGGCACCTCGACCCCAAAAAACTTGATTAGGGTGATGGTTCACGTAGTGGGCCATCGC
CCTGATAGACGGTTTTTCGCCCTTTGACGTTGGAGTCCACGTTCTTTAATAGTGGACTCT
TGTTCCAAACTGGAACAACACTCAACCCTATCTCGGTCTATTCTTTTGATTTATAAGGGA
TTTTGCCGATTTCGGCCTATTGGTTAAAAAATGAGCTGATTTAACAAATATTTAACGCGA
ATTTTAACAAAATATTAACGTTTACAATTTCGCCTGATGCGGTATTTTCTCCTTACGCAT
CTGTGCGGTATTTCACACCGCATACGCGGATCTGCGCAGCACCATGGCCTGAAATAACCT
CTGAAAGAGGAACTTGGTTAGGTACCTTCTGAGGCGGAAAGAACCAGCTGTGGAATGTGT
GTCAGTTAGGGTGTGGAAAGTCCCCAGGCTCCCCAGCAGGCAGAAGTATGCAAAGCATGC
ATCTCAATTAGTCAGCAACCAGGTGTGGAAAGTCCCCAGGCTCCCCAGCAGGCAGAAGTA
TGCAAAGCATGCATCTCAATTAGTCAGCAACCATAGTCCCGCCCCTAACTCCGCCCATCC
CGCCCCTAACTCCGCCCAGTTCCGCCCATTCTCCGCCCCATGGCTGACTAATTTTTTTTA
TTTATGCAGAGGCCGAGGCCGCCTCGGCCTCTGAGCTATTCCAGAAGTAGTGAGGAGGCT
TTTTTGGAGGCCTAGGCTTTTGCAAAAAGCTTGATTCTTCTGACACAACAGTCTCGAACT
TAAGGCTAGAGCCACCATGATTGAACAAGATGGATTGCACGCAGGTTCTCCGGCCGCTTG
GGTGGAGAGGCTATTCGGCTATGACTGGGCACAACAGACAATCGGCTGCTCTGATGCCGC
CGTGTTCCGGCTGTCAGCGCAGGGGCGCCCGGTTCTTTTTGTCAAGACCGACCTGTCCGG
TGCCCTGAATGAACTGCAGGACGAGGCAGCGCGGCTATCGTGGCTGGCCACGACGGGCGT
TCCTTGCGCAGCTGTGCTCGACGTTGTCACTGAAGCGGGAAGGGACTGGCTGCTATTGGG
CGAAGTGCCGGGGCAGGATCTCCTGTCATCTCACCTTGCTCCTGCCGAGAAAGTATCCAT
CATGGCTGATGCAATGCGGCGGCTGCATACGCTTGATCCGGCTACCTGCCCATTCGACCA
CCAAGCGAAACATCGCATCGAGCGAGCACGTACTCGGATGGAAGCCGGTCTTGTCGATCA
GGATGATCTGGACGAAGAGCATCAGGGGCTCGCGCCAGCCGAACTGTTCGCCAGGCTCAA
GGCGCGCATGCCCGACGGCGAGGATCTCGTCGTGACCCATGGCGATGCCTGCTTGCCGAA
TATCATGGTGGAAAATGGCCGCTTTTCTGGATTCATCGACTGTGGCCGGCTGGGTGTGGC
GGACCGCTATCAGGACATAGCGTTGGCTACCCGTGATATTGCTGAAGAGCTTGGCGGCGA
ATGGGCTGACCGCTTCCTCGTGCTTTACGGTATCGCCGCTCCCGATTCGCAGCGCATCGC
CTTCTATCGCCTTCTTGACGAGTTCTTCTGAGCGGGACTCTGGGGTTCGAAATGACCGAC
CAAGCGACGCCCAACCTGCCATCACGATGGCCGCAATAAAATATCTTTATTTTCATTACA
TCTGTGTGTTGGTTTTTTGTGTGAATCGATAGCGATAAGGATCCGCGTATGGTGCACTCT
CAGTACAATCTGCTCTGATGCCGCATAGTTAAGCCAGCCCCGACACCCGCCAACACCCGC
TGACGCGCCCTGACGGGCTTGTCTGCTCCCGGCATCCGCTTACAGACAAGCTGTGACCGT
CTCCGGGAGCTGCATGTGTCAGAGGTTTTCACCGTCATCACCGAAACGCGCGAGACGAAA
GGGCCTCGTGATACGCCTATTTTTATAGGTTAATGTCATGATAATAATGGTTTCTTAGAC
```

FIG.92C

```
GTCAGGTGGCACTTTTCGGGGAAATGTGCGCGGAACCCCTATTTGTTTATTTTTCTAAAT
ACATTCAAATATGTATCCGCTCATGAGACAATAACCCTGATAAATGCTTCAATAATATTG
AAAAAGGAAGAGTATGAGTATTCAACATTTCCGTGTCGCCCTTATTCCCTTTTTTGCGGC
ATTTTGCCTTCCTGTTTTTGCTCACCCAGAAACGCTGGTGAAAGTAAAAGATGCTGAAGA
TCAGTTGGGTGCACGAGTGGGTTACATCGAACTGGATCTCAACAGCGGTAAGATCCTTGA
GAGTTTTCGCCCCGAAGAACGTTTTCCAATGATGAGCACTTTTAAAGTTCTGCTATGTGG
CGCGGTATTATCCCGTATTGACGCCGGGCAAGAGCAACTCGGTCGCCGCATACACTATTC
TCAGAATGACTTGGTTGAGTACTCACCAGTCACAGAAAAGCATCTTACGGATGGCATGAC
AGTAAGAGAATTATGCAGTGCTGCCATAACCATGAGTGATAACACTGCGGCCAACTTACT
TCTGACAACGATCGGAGGACCGAAGGAGCTAACCGCTTTTTTGCACAACATGGGGGATCA
TGTAACTCGCCTTGATCGTTGGGAACCGGAGCTGAATGAAGCCATACCAAACGACGAGCG
TGACACCACGATGCCTGTAGCAATGGCAACAACGTTGCGCAAACTATTAACTGGCGAACT
ACTTACTCTAGCTTCCCGGCAACAATTAATAGACTGGATGGAGGCGGATAAAGTTGCAGG
ACCACTTCTGCGCTCGGCCCTTCCGGCTGGCTGGTTTATTGCTGATAAATCTGGAGCCGG
TGAGCGTGGGTCTCGCGGTATCATTGCAGCACTGGGGCCAGATGGTAAGCCCTCCCGTAT
CGTAGTTATCTACACGACGGGGAGTCAGGCAACTATGGATGAACGAAATAGACAGATCGC
TGAGATAGGTGCCTCACTGATTAAGCATTGGTAACTGTCAGACCAAGTTTACTCATATAT
ACTTTAGATTGATTTAAAACTTCATTTTTAATTTAAAAGGATCTAGGTGAAGATCCTTTT
TGATAATCTCATGACCAAAATCCCTTAACGTGAGTTTTCGTTCCACTGAGCGTCAGACCC
CGTAGAAAAGATCAAAGGATCTTCTTGAGATCCTTTTTTTCTGCGCGTAATCTGCTGCTT
GCAAACAAAAAAACCACCGCTACCAGCGGTGGTTTGTTTGCCGGATCAAGAGCTACCAAC
TCTTTTTCCGAAGGTAACTGGCTTCAGCAGAGCGCAGATACCAAATACTGTCCTTCTAGT
GTAGCCGTAGTTAGGCCACCACTTCAAGAACTCTGTAGCACCGCCTACATACCTCGCTCT
GCTAATCCTGTTACCAGTGGCTGCTGCCAGTGGCGATAAGTCGTGTCTTACCGGGTTGGA
CTCAAGACGATAGTTACCGGATAAGGCGCAGCGGTCGGGCTGAACGGGGGGTTCGTGCAC
ACAGCCCAGCTTGGAGCGAACGACCTACACCGAACTGAGATACCTACAGCGTGAGCATTG
AGAAAGCGCCACGCTTCCCGAAGGGAGAAAGGCGGACAGGTATCCGGTAAGCGGCAGGGT
CGGAACAGGAGAGCGCACGAGGGAGCTTCCAGGGGGAAACGCCTGGTATCTTTATAGTCC
TGTCGGGTTTCGCCACCTCTGACTTGAGCGTCGATTTTTGTGATGCTCGTCAGGGGGGCG
GAGCCTATGGAAAAACGCCAGCAACGCGGCCTTTTTACGGTTCCTGGCCTTTTGCTGGCC
TTTTGCTCACATGTTCTTTCCTGCGTTATCCCCTGATTCTGTGGATAACCGTATTACCGC
CTTTGAGTGAGCTGATACCGCTCGCCGCAGCCGAACGACCGAGCGCAGCGAGTCAGTGAG
CGAGGAAGCGGAAGAGCGCCCAATACGCAAACCGCCTCTCCCCGCGCGTTGGCCGATTCA
TTAATGCAGAGCTTGCAATTCGCGCGTTTTTCAATATTATTGAAGCATTTATCAGGGTTA
TTGTCTCATGAGCGGATACATATTTGAATGTATTTAGAAAAATAAACAAATAGGGGTTCC
GCGCACATTTCCCCGAAAAGTGCCACCTGACGTCTAAGAAACCATTATTATCATGACATT
AACCTATAAAAATAGGCGTAGTACGAGGCCCTTTCACTCATTAG
```

FIG.92D pDEST31 7559 bp

```
ATGCATGTCGTTACATAACTTACGGTAAATGGCCCGCCTGGCTGACCGCCCAACGACCCC
CGCCCATTGACGTCAATAATGACGTATGTTCCCATAGTAACGCCAATAGGGACTTTCCAT
TGACGTCAATGGGTGGAGTATTTACGGTAAACTGCCCACTTGGCAGTACATCAAGTGTAT
CATATGCCAAGTACGCCCCCTATTGACGTCAATGACGGTAAATGGCCCGCCTGGCATTAT
GCCCAGTACATGACCTTATGGGACTTTCCTACTTGGCAGTACATCTACGTATTAGTCATC
GCTATTACCATGGTGATGCGGTTTTGGCAGTACATCAATGGGCGTGGATAGCGGTTTGAC
TCACGGGGATTTCCAAGTCTCCACCCCATTGACGTCAATGGGAGTTTGTTTTGGCACCAA
AATCAACGGGACTTTCCAAAATGTCGTAACAACTCCGCCCCATTGACGCAAATGGGCGGT
AGGCGTGTACGGTGGGAGGTCTATATAAGCAGAGCTCTCCCTATCAGTGATAGAGATCTC
CCTATCAGTGATAGAGATCGTCGACGAGCTCGTTTAGTGAACCGTCAGATCGCCTGGAGA
CGCCATCCACGCTGTTTTGACCTCCATAGAAGACACCGGGACCGATCCAGCCTCCGGACC
ATGGCGTACTACCATCACCATCACCATCACACCGGTGATATCCTCGAGCCCATCACAAGT
TTGTACAAAAAAGCTGAACGAGAAACGTAAAATGATATAAATATCAATATATTAAATTAG
ATTTTGCATAAAAAACAGACTACATAATACTGTAAAACACAACATATCCAGTCACTATGG
CGGCCGCATTAGGCACCCCAGGCTTTACACTTTATGCTTCCGGCTCGTATAATGTGTGGA
TTTTGAGTTAGGATCCGGCGAGATTTTCAGGAGCTAAGGAAGCTAAAATGGAGAAAAAAA
TCACTGGATATACCACCGTTGATATATCCCAATGGCATCGTAAAGAACATTTTGAGGCAT
TTCAGTCAGTTGCTCAATGTACCTATAACCAGACCGTTCAGCTGGATATTACGGCCTTTT
TAAAGACCGTAAAGAAAAATAAGCACAAGTTTTATCCGGCCTTTATTCACATTCTTGCCC
GCCTGATGAATGCTCATCCGGAATTCCGTATGGCAATGAAAGACGGTGAGCTGGTGATAT
GGGATAGTGTTCACCCTTGTTACACCGTTTTCCATGAGCAAACTGAAACGTTTTCATCGC
TCTGGAGTGAATACCACGACGATTTCCGGCAGTTTCTACACATATATTCGCAAGATGTGG
CGTGTTACGGTGAAAACCTGGCCTATTTCCCTAAAGGGTTTATTGAGAATATGTTTTTCG
TCTCAGCCAATCCCTGGGTGAGTTTCACCAGTTTTGATTTAAACGTGGCCAATATGGACA
ACTTCTTCGCCCCCGTTTTCACCATGGGCAAATATTATACGCAAGGCGACAAGGTGCTGA
TGCCGCTGGCGATTCAGGTTCATCATGCCGTCTGTGATGGCTTCCATGTCGGCAGAATGC
TTAATGAATTACAACAGTACTGCGATGAGTGGCAGGGCGGGGCGTAAACGCGTGGATCCG
GCTTACTAAAAGCCAGATAACAGTATGCGTATTTGCGCGCTGATTTTTGCGGTATAAGAA
TATATACTGATATGTATACCCGAAGTATGTCAAAAAGAGGTGTGCTATGAAGCAGCGTAT
TACAGTGACAGTTGACAGCGACAGCTATCAGTTGCTCAAGGCATATATGATGTCAATATC
TCCGGTCTGGTAAGCACAACCATGCAGAATGAAGCCCGTCGTCTGCGTGCCGAACGCTGG
AAAGCGGAAAATCAGGAAGGGATGGCTGAGGTCGCCCGGTTTATTGAAATGAACGGCTCT
TTTGCTGACGAGAACAGGGACTGGTGAAATGCAGTTTAAGGTTTACACCTATAAAAGAGA
GAGCCGTTATCGTCTGTTTGTGGATGTACAGAGTGATATTATTGACACGCCCGGGCGACG
GATGGTGATCCCCCTGGCCAGTGCACGTCTGCTGTCAGATAAAGTCTCCCGTGAACTTTA
CCCGGTGGTGCATATCGGGGATGAAAGCTGGCGCATGATGACCACCGATATGGCCAGTGT
GCCGGTCTCCGTTATCGGGGAAGAAGTGGCTGATCTCAGCCACCGCGAAAATGACATCAA
AAACGCCATTAACCTGATGTTCTGGGGAATATAAATGTCAGGCTCCGTTATACACAGCCA
GTCTGCAGGTCGACCATAGTGACTGGATATGTTGTGTTTTACAGTATTATGTAGTCTGTT
TTTTATGCAAAATCTAATTTAATATATTGATATTTATATCATTTTACGTTTCTCGTTCAG
CTTTCTTGTACAAAGTGGTGATGGGCGGCCGCTCTAGAGGGCCCAAGCTTACGCGTGCAT
GCGACGTCATAGCTCTCTCCCTATAGTGAGTCGTATTATAAGCTAGGCACTGGCCGTCGT
TTTACAACGTCGTGACTGGGAAAACTGCTAGCTTGGGATCTTTGTGAAGGAACCTTACTT
```

FIG.93B

```
CTGTGGTGTGACATAATTGGACAAACTACCTACAGAGATTTAAAGCTCTAAGGTAAATAT
AAAATTTTTAAGTGTATAATGTGTTAAACTAGCTGCATATGCTTGCTGCTTGAGAGTTTT
GCTTACTGAGTATGATTTATGAAAATATTATACACAGGAGCTAGTGATTCTAATTGTTTG
TGTATTTTAGATTCACAGTCCCAAGGCTCATTTCAGGCCCCTCAGTCCTCACAGTCTGTT
CATGATCATAATCAGCCATACCACATTTGTAGAGGTTTTACTTGCTTTAAAAAACCTCCC
ACACCTCCCCCTGAACCTGAAACATAAAATGAATGCAATTGTTGTTGTTAACTTGTTTAT
TGCAGCTTATAATGGTTACAAATAAAGCAATAGCATCACAAATTTCACAAATAAAGCATT
TTTTTCACTGCATTCTAGTTGTGGTTTGTCCAAACTCATCAATGTATCTTATCATGTCTG
GATCGATCCTGCATTAATGAATCGGCCAACGCGCGGGGAGAGGCGGTTTGCGTATTGGCT
GGCGTAATAGCGAAGAGGCCCGCACCGATCGCCCTTCCCAACAGTTGCGCAGCCTGAATG
GCGAATGGGACGCGCCCTGTAGCGGCGCATTAAGCGCGGCGGGTGTGGTGGTTACGCGCA
GCGTGACCGCTACACTTGCCAGCGCCCTAGCGCCCGCTCCTTTCGCTTTCTTCCCTTCCT
TTCTCGCCACGTTCGCCGGCTTTCCCCGTCAAGCTCTAAATCGGGGGCTCCCTTTAGGGT
TCCGATTTAGTGCTTTACGGCACCTCGACCCCAAAAAACTTGATTAGGGTGATGGTTCAC
GTAGTGGGCCATCGCCCTGATAGACGGTTTTTCGCCCTTTGACGTTGGAGTCCACGTTCT
TTAATAGTGGACTCTTGTTCCAAACTGGAACAACACTCAACCCTATCTCGGTCTATTCTT
TTGATTTATAAGGGATTTTGCCGATTTCGGCCTATTGGTTAAAAAATGAGCTGATTTAAC
AAATATTTAACGCGAATTTTAACAAAATATTAACGTTTACAATTTCGCCTGATGCGGTAT
TTTCTCCTTACGCATCTGTGCGGTATTTCACACCGCATACGCGGATCTGCGCAGCACCAT
GGCCTGAAATAACCTCTGAAAGAGGAACTTGGTTAGGTACCTTCTGAGGCGGAAAGAACC
AGCTGTGGAATGTGTGTCAGTTAGGGTGTGGAAAGTCCCCAGGCTCCCCAGCAGGCAGAA
GTATGCAAAGCATGCATCTCAATTAGTCAGCAACCAGGTGTGGAAAGTCCCCAGGCTCCC
CAGCAGGCAGAAGTATGCAAAGCATGCATCTCAATTAGTCAGCAACCATAGTCCCGCCCC
TAACTCCGCCCATCCCGCCCCTAACTCCGCCCAGTTCCGCCCATTCTCCGCCCCATGGCT
GACTAATTTTTTTTATTTATGCAGAGGCCGAGGCCGCCTCGGCCTCTGAGCTATTCCAGA
AGTAGTGAGGAGGCTTTTTTGGAGGCCTAGGCTTTTGCAAAAAGCTTGATTCTTCTGACA
CAACAGTCTCGAACTTAAGGCTAGAGCCACCATGATTGAACAAGATGGATTGCACGCAGG
TTCTCCGGCCGCTTGGGTGGAGAGGCTATTCGGCTATGACTGGGCACAACAGACAATCGG
CTGCTCTGATGCCGCCGTGTTCCGGCTGTCAGCGCAGGGGCGCCCGGTTCTTTTTGTCAA
GACCGACCTGTCCGGTGCCCTGAATGAACTGCAGGACGAGGCAGCGCGGCTATCGTGGCT
GGCCACGACGGGCGTTCCTTGCGCAGCTGTGCTCGACGTTGTCACTGAAGCGGGAAGGGA
CTGGCTGCTATTGGGCGAAGTGCCGGGGCAGGATCTCCTGTCATCTCACCTTGCTCCTGC
CGAGAAAGTATCCATCATGGCTGATGCAATGCGGCGGCTGCATACGCTTGATCCGGCTAC
CTGCCCATTCGACCACCAAGCGAAACATCGCATCGAGCGAGCACGTACTCGGATGGAAGC
CGGTCTTGTCGATCAGGATGATCTGGACGAAGAGCATCAGGGGCTCGCGCCAGCCGAACT
GTTCGCCAGGCTCAAGGCGCGCATGCCCGACGGCGAGGATCTCGTCGTGACCCATGGCGA
TGCCTGCTTGCCGAATATCATGGTGGAAAATGGCCGCTTTTCTGGATTCATCGACTGTGG
CCGGCTGGGTGTGGCGGACCGCTATCAGGACATAGCGTTGGCTACCCGTGATATTGCTGA
AGAGCTTGGCGGCGAATGGGCTGACCGCTTCCTCGTGCTTTACGGTATCGCCGCTCCCGA
TTCGCAGCGCATCGCCTTCTATCGCCTTCTTGACGAGTTCTTCTGAGCGGGACTCTGGGG
TTCGAAATGACCGACCAAGCGACGCCCAACCTGCCATCACGATGGCCGCAATAAAATATC
TTTATTTTCATTACATCTGTGTGTTGGTTTTTTGTGTGAATCGATAGCGATAAGGATCCG
CGTATGGTGCACTCTCAGTACAATCTGCTCTGATGCCGCATAGTTAAGCCAGCCCCGACA
CCCGCCAACACCCGCTGACGCGCCCTGACGGGCTTGTCTGCTCCCGGCATCCGCTTACAG
ACAAGCTGTGACCGTCTCCGGGAGCTGCATGTGTCAGAGGTTTTCACCGTCATCACCGAA
ACGCGCGAGACGAAAGGGCCTCGTGATACGCCTATTTTTATAGGTTAATGTCATGATAAT
```

FIG.93C

```
AATGGTTTCTTAGACGTCAGGTGGCACTTTTCGGGGAAATGTGCGCGGAACCCCTATTTG
TTTATTTTTCTAAATACATTCAAATATGTATCCGCTCATGAGACAATAACCCTGATAAAT
GCTTCAATAATATTGAAAAAGGAAGAGTATGAGTATTCAACATTTCCGTGTCGCCCTTAT
TCCCTTTTTTGCGGCATTTTGCCTTCCTGTTTTTGCTCACCCAGAAACGCTGGTGAAAGT
AAAAGATGCTGAAGATCAGTTGGGTGCACGAGTGGGTTACATCGAACTGGATCTCAACAG
CGGTAAGATCCTTGAGAGTTTTCGCCCCGAAGAACGTTTTCCAATGATGAGCACTTTTAA
AGTTCTGCTATGTGGCGCGGTATTATCCCGTATTGACGCCGGGCAAGAGCAACTCGGTCG
CCGCATACACTATTCTCAGAATGACTTGGTTGAGTACTCACCAGTCACAGAAAAGCATCT
TACGGATGGCATGACAGTAAGAGAATTATGCAGTGCTGCCATAACCATGAGTGATAACAC
TGCGGCCAACTTACTTCTGACAACGATCGGAGGACCGAAGGAGCTAACCGCTTTTTTGCA
CAACATGGGGGATCATGTAACTCGCCTTGATCGTTGGGAACCGGAGCTGAATGAAGCCAT
ACCAAACGACGAGCGTGACACCACGATGCCTGTAGCAATGGCAACAACGTTGCGCAAACT
ATTAACTGGCGAACTACTTACTCTAGCTTCCCGGCAACAATTAATAGACTGGATGGAGGC
GGATAAAGTTGCAGGACCACTTCTGCGCTCGGCCCTTCCGGCTGGCTGGTTTATTGCTGA
TAAATCTGGAGCCGGTGAGCGTGGGTCTCGCGGTATCATTGCAGCACTGGGGCCAGATGG
TAAGCCCTCCCGTATCGTAGTTATCTACACGACGGGGAGTCAGGCAACTATGGATGAACG
AAATAGACAGATCGCTGAGATAGGTGCCTCACTGATTAAGCATTGGTAACTGTCAGACCA
AGTTTACTCATATATACTTTAGATTGATTTAAAACTTCATTTTTAATTTAAAAGGATCTA
GGTGAAGATCCTTTTTGATAATCTCATGACCAAAATCCCTTAACGTGAGTTTTCGTTCCA
CTGAGCGTCAGACCCCGTAGAAAAGATCAAAGGATCTTCTTGAGATCCTTTTTTTCTGCG
CGTAATCTGCTGCTTGCAAACAAAAAAACCACCGCTACCAGCGGTGGTTTGTTTGCCGGA
TCAAGAGCTACCAACTCTTTTTCCGAAGGTAACTGGCTTCAGCAGAGCGCAGATACCAAA
TACTGTCCTTCTAGTGTAGCCGTAGTTAGGCCACCACTTCAAGAACTCTGTAGCACCGCC
TACATACCTCGCTCTGCTAATCCTGTTACCAGTGGCTGCTGCCAGTGGCGATAAGTCGTG
TCTTACCGGGTTGGACTCAAGACGATAGTTACCGGATAAGGCGCAGCGGTCGGGCTGAAC
GGGGGGTTCGTGCACACAGCCCAGCTTGGAGCGAACGACCTACACCGAACTGAGATACCT
ACAGCGTGAGCATTGAGAAAGCGCCACGCTTCCCGAAGGGAGAAAGGCGGACAGGTATCC
GGTAAGCGGCAGGGTCGGAACAGGAGAGCGCACGAGGGAGCTTCCAGGGGGAAACGCCTG
GTATCTTTATAGTCCTGTCGGGTTTCGCCACCTCTGACTTGAGCGTCGATTTTTGTGATG
CTCGTCAGGGGGCGGAGCCTATGGAAAAACGCCAGCAACGCGGCCTTTTTACGGTTCCT
GGCCTTTTGCTGGCCTTTTGCTCACATGTTCTTTCCTGCGTTATCCCCTGATTCTGTGGA
TAACCGTATTACCGCCTTTGAGTGAGCTGATACCGCTCGCCGCAGCCGAACGACCGAGCG
CAGCGAGTCAGTGAGCGAGGAAGCGGAAGAGCGCCCAATACGCAAACCGCCTCTCCCCGC
GCGTTGGCCGATTCATTAATGCAGAGCTTGCAATTCGCGCGTTTTTCAATATTATTGAAG
CATTTATCAGGGTTATTGTCTCATGAGCGGATACATATTTGAATGTATTTAGAAAAATAA
ACAAATAGGGGTTCCGCGCACATTTCCCCGAAAAGTGCCACCTGACGTCTAAGAAACCAT
TATTATCATGACATTAACCTATAAAAATAGGCGTAGTACGAGGCCCTTTCACTCATTAG
```

FIG.93D pDEST32 12288 bp

```
GACGAAAGGGCCTCGTGATACGCCTATTTTTATAGGTTAATGTCATGATAATAATGGTTT
CTTAGGACGGATCGCTTGCCTGTAACTTACACGCGCCTCGTATCTTTTAATGATGGAATA
ATTTGGGAATTTACTCTGTGTTTATTTATTTTTATGTTTTGTATTTGGATTTTAGAAAGT
AAATAAAGAAGGTAGAAGAGTTACGGAATGAAGAAAAAAAAATAAACAAAGGTTTAAAAA
ATTTCAACAAAAAGCGTACTTTACATATATATTTATTAGACAAGAAAAGCAGATTAAATA
GATATACATTCGATTAACGATAAGTAAAATGTAAAATCACAGGATTTTCGTGTGTGGTCT
TCTACACAGACAAGATGAAACAATTCGGCATTAATACCTGAGAGCAGGAAGAGCAAGATA
AAAGGTAGTATTTGTTGGCGATCCCCCTAGAGTCTTTTACATCTTCGGAAAACAAAAACT
ATTTTTTCTTTAATTTCTTTTTTTACTTTCTATTTTTAATTTATATATTTATATTAAAAA
ATTTAAATTATAATTATTTTTATAGCACGTGATGAAAAGGACCCAGGTGGCACTTTTCGG
GGAAATGTGCGCGGAACCCCTATTTGTTTATTTTTCTAAATACATTCAAATATGTATCCG
CTCATGAGACAATAACCCTGATAAATGCTTCAATAATCTGCAGTGCGCAGGGCCCGTGTC
TCAAAATCTCTGATGTTACATTGCACAAGATAAAAATATATCATCATGAACAATAAAACT
GTCTGCTTACATAAACAGTAATACAAGGGGTGTTATGAGCCATATTCAACGGGAAACGTC
TTGCTGGAGGCCGCGATTAAATTCCAACATGGATGCTGATTTATATGGGTATAAATGGGC
TCGGTAGCCAACCACTAGAACTATAGCTAGAGTCCTGGGCGAACAAACGATGCTCGCCTT
CCAGAAAACCGAGGATGCGAACCACTTCATCCGGGGTCAGCACCACCGGCAAGCGCCGCG
ACGGCCGAGGTCTTCCGATCTCCTGAAGCCAGGGCAGATCCGTGCACAGCACCTTGCCGT
AGAAGAACAGCAAGGCCGCCAATGCCTGACGATGCGTGGAGACCGAAACCTTGCGCTCGT
TCGCCAGCCAGGACAGAAATGCCTCGACTTCGCTGCTGCCCAAGGTTGCCGGGTGACGCA
CACCGTGGAAACGGATGAAGGCACGAACCCAGTTGACATAAGCCTGTTCGGTTCGTAAAC
TGTAATGCAAGTAGCGTATGCGCTCACGCAACTGGTCCAGAACCTTGACCGAACGCAGCG
GTGGTAACGGCGCAGTGGCGGTTTTCATGGCTTGTTATGACTGTTTTTTTGTACAGTCTA
TGCCTCGGGCATCCAAGCAGCAAGCGCGTTACGCCGTGGGTCGATGTTTGATGTTATGGA
GCAGCAACGATGTTACGCAGCAGCAACGATGTTACGCAGCAGGGCAGTCGCCCTAAAACA
AAGTTAGGTGGCTCAAGTATGGGCATCATTCGCACATGTAGGCTCGGCCCTGACCAAGTC
AAATCCATGCGGGCTGCTCTTGATCTTTTCGGTCGTGAGTTCGGAGACGTAGCCACCTAC
TCCCAACATCAGCCGGACTCCGATTACCTCGGGAACTTGCTCCGTAGTAAGACATTCATC
GCGCTTGCTGCCTTCGACCAAGAAGCGGTTGTTGGCGCTCTCGCGGCTTACGTTCTGCCC
AGGTTTGAGCAGCCGCGTAGTGAGATCTATATCTATGATCTCGCAGTCTCCGGCGAGCAC
CGGAGGCAGGGCATTGCCACCGCGCTCATCAATCTCCTCAAGCATGAGGCCAACGCGCTT
GGTGCTTATGTGATCTACGTGCAAGCAGATTACGGTGACGATCCCGCAGTGGCTCTCTAT
ACAAAGTTGGGCATACGGGAAGAAGTGATGCACTTTGATATCGACCCAAGTACCGCCACC
TAACAATTCGTTCAAGCCGAGATCGGCTTCCCGGCCTAATAGGTTGTATTGATGTTGGAC
GAGTCGGAATCGCAGACCGATACCAGGATCTTGCCATCCTATGGAACTGCCTCGGTGAGT
TTTCTCCTTCATTACAGAAACGGCTTTTTCAAAAATATGGTATTGATAATCCTGATATGA
ATAAATTGCAGTTTCATTTGATGCTCGATGAGTTTTTCTAATCAGAATTGGTTAATTGGT
TGTAACACTGGCAGAGCATTACGCTGACTTGACGGGACGGCGNCATGACCAAAATCCCTT
AACGTGAGTTTTCGTTCCACTGAGCGTCAGACCCCGTAGAAAAGATCAAAGGATCTTCTT
GAGATCCTTTTTTTTCTGCGCGTAATCTGCTGCTTGCAAACAAAAAAACCACCGCTACCAG
```

FIG.94B

```
CGGTGGTTTGTTTGCCGGATCAAGAGCTACCAACTCTTTTTTCCGAAGGTAACTGGCTTCA
GCAGAGCGCAGATACCAAATACTGTCCTTCTAGTGTAGCCGTAGTTAGGCCACCACTTCA
AGAACTCTGTAGCACCGCCTACATACCTCGCTCTGCTAATCCTGTTACCAGTGGCTGCTG
CCAGTGGCGATAAGTCGTGTCTTACCGGGTTGGACTCAAGACGATAGTTACCGGATAAGG
CGCAGCGGTCGGGCTGAACGGGGGGTTCGTGCACACAGCCCAGCTTGGAGCGAACGACCT
ACACCGAACTGAGATACCTACAGCGTGAGCATTGAGAAAGCGCCACGCTTCCCGAAGGGA
GAAAGGCGGACAGGTATCCGGTAAGCGGCAGGGTCGGAACAGGAGAGCGCACGAGGGAGC
TTCCAGGGGGGAACGCCTGGTATCTTTATAGTCCTGTCGGGTTTCGCCACCTCTGACTTG
AGCGTCGATTTTTTGTGATGCTCGTCAGGGGGGCCGAGCCTATGGAAAAACGCCAGCAACG
CGGCCTTTTTACGGTTCCTGGCCTTTTGCTGGCCTTTTGCTCACATGTTCTTTCCTGCGT
TATCCCCTGATTCTGTGGATAACCGTATTACCGCCTTTGAGTGAGCTGATACCGCTCGCC
GCAGCCGAACGACCGAGCGCAGCGAGTCAGTGAGCGAGGAAGCGGAAGAGCGCCCAATAC
GCAAACCGCCTCTCCCCGCGCGTTGGCCGATTCATTAATGCAGCTGGCACGACAGGTTTC
CCGACTGGAAAGCGGGCAGTGAGCGCAACGCAATTAATGTGAGTTACCTCACTCATTAGG
CACCCCAGGCTTTACACTTTATGCTTCCGGCTCCTATGTTGTGTGGAATTGTGAGCGGAT
AACAATTTCACACAGGAAACAGCTATGACCATGATTACGCCAAGCTCGGAATTAACCCTC
ACTAAAGGGAACAAAAGCTGGTACCGATCCCGAGCTTTGCAAATTAAAGCCTTCGAGCGT
CCCAAAACCTTCTCAAGCAAGGTTTTCAGTATAATGTTACATGCGTACACGCGTCTGTAC
AGAAAAAAAAGAAAAATTTGAAATATAAATAACGTTCTTAATACTAACATAACTATAAAA
AAATAAATAGGGACCTAGACTTCAGGTTGTCTAACTCCTTCCTTTTCGGTTAGAGCGGAT
GTGGGGGGAGGGCGTGAATGTAAGCGTGACATAACTAATTACATGATATCGACAAAGGAA
AAGGGGCCTGTTTACTCACAGGCTTTTTTCAAGTAGGTAATTAAGTCGTTTCTGTCTTTT
TCCTTCTTCAACCCACCAAAGGCCATCTTGGTACTTTTTTTTTTTTTTTTTTTTTTTTTT
TTTTTTTTTTTTTTTTTTTTTTTTTTTTTTTTTTTTTTTTTTTTTTTTTTTTTTTTTTTT
TTTTTTTTCATAGAAATAATACAGAAGTAGATGTTGAATTAGATTAAACTGAAGATATAT
AATTTATTGGAAAATACATAGAGCTTTTTGTTGATGCGCTTAAGCGATCAATTCAACAAC
ACCACCAGCAGCTCTGATTTTTTTCTTCAGCCAACTTGGAGACGAATCTAGCTTTGACGAT
AACTGGAACATTTGGAATTCTACCCTTACCCAAGATCTTACCGTAACCGGCTGCCAAAGT
GTCAATAACTGGAGCAGTTTCCTTAGAAGCAGATTTCAAGTATTGGTCTCTCTTGTCTTC
TGGGATCAATGTCCACAATTTGTCCAAGTTCAAGACTGGCTTCCAGAAATGAGCTTGTTG
CTTGTGGAAGTATCTCATACCAACCTTACCGAAATAACCTGGATGGTATTTATCCATGTT
AATTCTGTGGTGATGTTGACCACCGGCCATACCTCTACCACCGGGGTGCTTTCTGTGCTT
ACCGATACGACCTTTACCGGCTGAGACGTGACCTCTGTGCTTTCTAGTCTTAGTGAATCT
GGAAGGCATTCTTGATTAGTTGGATGATTGTTCTGGGATTTAATGCAAAAATCACTTAAG
AAGGAAAATCAACGGAGAAAGCAAACGCCATCTTAAATATACGGGATACAGATGAAAGGG
TTTGAACCTATCTGGAAAATAGCATTAAACAAGCGAAAAACTGCGAGGAAAATTGTTTGC
GTCTCTGCGGGCTATTCACGCGCCAGAGGAAAATAGGAAAAATAACAGGGCATTAGAAAA
ATAATTTTGATTTTGGTAATGTGTGGGTCCTGGTGTACAGATGTTACATTGGTTACAGTA
CTCTTGTTTTTGCTGTGTTTTCGATGAATCTCCAAAATGGTTGTTAGCACATGGAAGAG
TCACCGATGCTAAGTTATCTCTATGTAAGCTACGTGGCGTGACTTTTGATGAAGCCGCAC
AAGAGATACAGGATTGGCAACTGCAAATAGAATCTGGGGATCCCCCCTCGAGATCCGGGA
TCGAAGAAATGATGGTAAATGAAATAGGAAATCAAGGAGCATGAAGGCAAAAGACAAATA
TAAGGGTCGAACGAAAAATAAAGTGAAAAGTGTTGATATGATGTATTTGGCTTTGCGGCG
```

FIG.94C

```
CCGAAAAAACGAGTTTACGCAATTGCACAATCATGCTGACTCTGTGGCGGACCCGCGCTC
TTGCCGGCCCGGCGATAACGCTGGGCGTGAGGCTGTGCCCGGCGGAGTTTTTTGCGCCTG
CATTTTTCCAAGGTTTACCCTGCGCTAAGGGGCGAGATTGGAGAAGCAATAAGAATGCCGG
TTGGGGTTGCGATGATGACGACCACGACAACTGGTGTCATTATTTAAGTTGCCGAAAGAA
CCTGAGTGCATTTGCAACATGAGTATACTAGAAGAATGAGCCAAGACTTGCGAGACGCGA
GTTTGCCGGTGGTGCGAACAATAGAGCGACCATGACCTTGAAGGTGAGACGCGCATAACC
GCTAGAGTACTTTGAAGAGGAAACAGCAATAGGGTTGCTACCAGTATAAATAGACAGGTA
CATACAACACTGGAAATGGTTGTCTGTTTGAGTACGCTTTCAATTCATTTGGGTGTGCAC
TTTATTATGTTACAATATGGAAGGGAACTTTACACTTCTCCTATGCACATATATTAATTA
AAGTCCAATGCTAGTAGAGAAGGGGGGTAACACCCCTCCGCGCTCTTTTCCGATTTTTTT
CTAAACCGTGGAATATTTCGGATATCCTTTTGTTGTTTCCGGGTGTACAATATGGACTTC
CTCTTTTCTGGCAACCAAACCCATACATCGGGATTCCTATAATACCTTCGTTGGTCTCCC
TAACATGTAGGTGGCGGAGGGGAGATATACAATAGAACAGATACCAGACAAGACATAATG
GGCTAAACAAGACTACACCAATTACACTGCCTCATTGATGGTGGTACATAACGAACTAAT
ACTGTAGCCCTAGACTTGATAGCCATCATCATATCGAAGTTTCACTACCCTTTTTCCATT
TGCCATCTATTGAAGTAATAATAGGCGCATGCAACTTCTTTTCTTTTTTTTCTTTTCTC
TCTCCCCCGTTGTTGTCTCACCATATCCGCAATGACAAAAAAAATGATGGAAGACACTAA
AGGAAAAAATTAACGACAAAGACAGCACCAACAGATGTCGTTGTTCCAGAGCTGATGAGG
GGTATCTTCGAACACACGAAACTTTTTCCTTCCTTCATTCACGCACACTACTCTCTAATG
AGCAACGGTATACGGCCTTCCTTCCAGTTACTTGAATTTGAAATAAAAAAAGTTTGCCGC
TTTGCTATCAAGTATAAATAGACCTGCAATTATTAATCTTTTGTTTCCTCGTCATTGTTC
TCGTTCCCTTTCTTCCTTGTTTCTTTTTCTGCACAATATTTCAAGCTATACCAAGCATAC
AATCAACTCCAAGCTTGAAGCAAGCCTCCTGAAAGATGAAGCTACTGTCTTCTATCGAAC
AAGCATGCGATATTTGCCGACTTAAAAAGCTCAAGTGCTCCAAAGAAAAACCGAAGTGCG
CCAAGTGTCTGAAGAACAACTGGGAGTGTCGCTACTCTCCCAAAACCAAAAGGTCTCCGC
TGACTAGGGCACATCTGACAGAAGTGGAATCAAGGCTAGAAAGACTGGAACAGCTATTTC
TACTGATTTTTCCTCGAGAAGACCTTGACATGATTTTGAAAATGGATTCTTTACAGGATA
TAAAAGCATTGTTAACAGGATTATTTGTACAAGATAATGTGAATAAAGATGCCGTCACAG
ATAGATTGGCTTCAGTGGAGACTGATATGCCTCTAACATTGAGACAGCATAGAATAAGTG
CGACATCATCATCGGAAGAGAGTAGTAACAAAGGTCAAAGACAGTTGACTGTATCGTCGA
GGTCGAATCAAACAAGTTTGTACAAAAAAGCTGAACGAGAAACGTAAAATGATATAAATA
TCAATATATTAAATTAGATTTTGCATAAAAAACAGACTACATAATACTGTAAAACACAAC
ATATCCAGTCACTATGGCGGCCGCTAAGTTGGCAGCATCACCCGACGCACTTTGCGCCGA
ATAAATACCTGTGACGGAAGATCACTTCGCAGAATAAATAAATCCTGGTGTCCCTGTTGA
TACCGGGAAGCCCTGGGCCAACTTTTGGCGAAAATGAGACGTTGATCGGCACGTAAGAGG
TTCCAACTTTCACCATAATGAAATAAGATCACTACCGGGCGTATTTTTTGAGTTATCGAG
ATTTTCAGGAGCTAAGGAAGCTAAAATGGAGAAAAAAATCACTGGATATACCACCGTTGA
TATATCCCAATGGCATCGTAAAGAACATTTTGAGGCATTTCAGTCAGTTGCTCAATGTAC
CTATAACCAGACCGTTCAGCTGGATATTACGGCCTTTTTAAAGACCGTAAAGAAAAATAA
GCACAAGTTTTATCCGGCCTTTATTCACATTCTTGCCCGCCTGATGAATGCTCATCCGGA
ATTCCGTATGGCAATGAAAGACGGTGAGCTGGTGATATGGGATAGTGTTCACCCTTGTTA
CACCGTTTTCCATGAGCAAACTGAAACGTTTTCATCGCTCTGGAGTGAATACCACGACGA
TTTCCGGCAGTTTCTACACATATATTCGCAAGATGTGGCGTGTTACGGTGAAAACCTGGC
```

FIG.94D

```
CTATTTCCCTAAAGGGTTTATTGAGAATATGTTTTTCGTCTCAGCCAATCCCTGGGTGAG
TTTCACCAGTTTTGATTTAAACGTGGCCAATATGGACAACTTCTTCGCCCCCGTTTTCAC
CATGGGCAAATATTATACGCAAGGCGACAAGGTGCTGATGCCGCTGGCGATTCAGGTTCA
TCATGCCGTCTGTGATGGCTTCCATGTCGGCAGAATGCTTAATGAATTACAACAGTACTG
CGATGAGTGGCAGGGCGGGGCGTAATCTAGAGGATCCGGCTTACTAAAAGCCAGATAACA
GTATGCGTATTTGCGCGCTGATTTTTGCGGTATAAGAATATATACTGATATGTATACCCG
AAGTATGTCAAAAAGAGGTGTGCTATGAAGCAGCGTATTACAGTGACAGTTGACAGCGAC
AGCTATCAGTTGCTCAAGGCATATATGATGTCAATATCTCCGGTCTGGTAAGCACAACCA
TGCAGAATGAAGCCCGTCGTCTGCGTGCCGAACGCTGGAAAGCGGAAAATCAGGAAGGGA
TGGCTGAGGTCGCCCGGTTTATTGAAATGAACGGCTCTTTTGCTGACGAGAACAGGGACT
GGTGAAATGCAGTTTAAGGTTTACACCTATAAAAGAGAGAGCCGTTATCGTCTGTTTGTG
GATGTACAGAGTGATATTATTGACACGCCCGGGCGACGGATGGTGATCCCCCTGGCCAGT
GCACGTCTGCTGTCAGATAAAGTCTCCCGTGAACTTTACCCGGTGGTGCATATCGGGGAT
GAAAGCTGGCGCATGATGACCACCGATATGGCCAGTGTGCCGGTCTCCGTTATCGGGGAA
GAAGTGGCTGATCTCAGCCACCGCGAAAATGACATCAAAAACGCCATTAACCTGATGTTC
TGGGGAATATAAATGTCAGGCTCCCTTATACACAGCCAGTCTGCAGGTCGACCATAGTGA
CTGGATATGTTGTGTTTTACAGTATTATGTAGTCTGTTTTTTATGCAAAATCTAATTTAA
TATATTGATATTTATATCATTTTACGTTTCTCGTTCAGCTTTCTTGTACAAAGTGGTTTG
ATGGCCGCTAAGTAAGTAAGACGTCGAGCTCTAAGTAAGTAACGGCCGCCACCGCGGTGG
AGCTTTGGACTTCTTCGCCAGAGGTTTGGTCAAGTCTCCAATCAAGGTTGTCGGCTTGTC
TACCTTGCCAGAAATTTACGAAAAGATGGAAAAGGGTCAAATCGTTGGTAGATACGTTGT
TGACACTTCTAAATAAGCGAATTTCTTATGATTTATGATTTTTATTATTAAATAAGTTAT
AAAAAAAATAAGTGTATACAAATTTTAAAGTGACTCTTAGGTTTTAAAACGAAAATTCTT
GTTCTTGAGTAACTCTTTCCTGTAGGTCAGGTTGCTTTCTCAGGTATAGCATGAGGTCGC
TCTTATTGACCACACCTCTACCGGCATGCCGAGCAAATGCCTGCAAATCGCTCCCCATTT
CACCCAATTGTAGATATGCTAACTCCAGCAATGAGTTGATGAATCTCGGTGTGTATTTTA
TGTCCTCAGAGGACAATACCTGTTGTAATCGTTCTTCCACACGGATCCCAATTCGCCCTA
TAGTGAGTCGTATTACAATTCACTGGCCGTCGTTTTACAACGTCGTGACTGGGAAAACCC
TGGCGTTACCCAACTTAATCGCCTTGCAGCACATCCCCCTTTCGCCAGCTGGCGTAATAG
CGAAGAGGCCCGCACCGATCGCCCTTCCCAACAGTTGCGCAGCCTGAATGGCGAATGGAC
GCGCCCTGTAGCGGCGCATTAAGCGCGGCGGGTGTGGTGGTTACGCGCAGCGTGACCGCT
ACACTTGCCAGCGCCCTAGCGCCCGCTCCTTTCGCTTTCTTCCCTTCCTTTCTCGCCACG
TTCGCCGGCTTTCCCCGTCAAGCTCTAAATCGGGGGCTCCCTTTAGGGTTCCGATTTAGT
GCTTTACGGCACCTCGACCCCAAAAAACTTGATTAGGGTGATGGTTCACGTAGTGGGCCA
TCGCCCTGATAGACGGTTTTTCGCCCTTTGACGTTGGAGTCCACGTTCTTTAATAGTGGA
CTCTTGTTCCAAACTGGAACAACACTCAACCCTATCTCGGTCTATTCTTTTGATTTATAA
GGGATTTTGCCGATTTCGGCCTATTGGTTAAAAAATGAGCTGATTTAACAAAAATTTAAC
GCGAATTTTAACAAAATATTAACGTTTACAATTTCCTGATGCGGTATTTTCTCCTTACGC
ATCTGTGCGGTATTTCACACCGCATATCGACCGGTCGAGGAGAACTTCTAGTATATCCAC
ATACCTAATATTATTGCCTTATTAAAAATGGAATCGGAACAATTACATCAAAATCCACAT
TCTCTTCAAAATCAATTGTCCTGTACTTCCTTGTTCATGTGTGTTCAAAAACGTTATATT
TATAGGATAATTATACTCTATTTCTCAACAAGTAATTGGTTGTTTGGCCGAGCGGTCTAA
GGCGCCTGATTCAAGAAATATCTTGACCGCAGTTAACTGTGGGAATACTCAGGTATCGTA
```

FIG.94E

```
AGATGCAAGAGTTCGAATCTCTTAGCAACCATTATTTTTTTCCTCAACATAACGAGAACA
CACAGGGGCGCTATCGCACAGAATCAAATTCGATGACTGGAAATTTTTTGTTAATTTCAG
AGGTCGCCTGACGCATATACCTTTTTTCAACTGAAAAATTGGGAGAAAAAGGAAAGGTGAG
AGGCCGGAACCGGCTTTTCATATAGAATAGAGAAGCGTTCATGACTAAATGCTTGCATCA
CAATACTTGAAGTTGACAATATTATTTAAGGACCTATTGTTTTTTCCAATAGGTGGTTAG
CAATCGTCTTACTTTCTAACTTTTCTTACCTTTTACATTTCAGCAATATATATATATATT
TCAAGGATATACCATTCTAATGTCTGCCCCTATGTCTGCCCCTAAGAAGATCGTCGTTTT
GCCAGGTGACCACGTTGGTCAAGAAATCACAGCCGAAGCCATTAAGGTTCTTAAAGCTAT
TTCTGATGTTCGTTCCAATGTCAAGTTCGATTTCGAAAATCATTTAATTGGTGGTGCTGC
TATCGATGCTACAGGTGTCCCACTTCCAGATGAGGCGCTGGAAGCCTCCAAGAAGGTTGA
TGCCGTTTTGTTAGGTGCTGTGGGTGGTCCTAAATGGGGTACCGGTAGTGTTAGACCTGA
ACAAGGTTTACTAAAAATCCGTAAAGAACTTCAATTGTACGCCAACTTAAGACCATGTAA
CTTTGCATCCGACTCTCTTTTAGACTTATCTCCAATCAAGCCACAATTTGCTAAAGGTAC
TGACTTCGTTGTTGTCAGAGAATTAGTGGGAGGTATTTACTTTGGTAAGAGAAAGGAAGA
CGATGGTGATGGTGTCGCTTGGGATAGTGAACAATACACCGTTCCAGAAGTGCAAAGAAT
CACAAGAATGGCCGCTTTCATGGCCCTACAACATGAGCCACCATTGCCTATTTGGTCCTT
GGATAAAGCTAATGTTTTGGCCTCTTCAAGATTATGGAGAAAAACTGTGGAGGAAACCAT
CAAGAACGAATTCCCTACATTGAAGGTTCAACATCAATTGATTGATTCTGCCGCCATGAT
CCTAGTTAAGAACCCAACCCACCTAAATGGTATTATAATCACCAGCAACATGTTTGGTGA
TATCATCTCCGATGAAGCCTCCGTTATCCCAGGTTCCTTGGGTTTGTTGCCATCTGCGTC
CTTGGCCTCTTTGCCAGACAAGAACACCGCATTTGGTTTGTACGAACCATGCCACGGTTC
TGCTCCAGATTTGCCAAAGAATAAGGTTGACCCTATCGCCACTATCTTGTCTGCTGCAAT
GATGTTGAAATTGTCATTGAACTTGCCTGAAGAAGGTAAGGCCATTGAAGATGCAGTTAA
AAAGGTTTTGGATGCAGGTATCAGAACTGGTGATTTAGGTGGTTCCAACAGTACCACCGA
AGTCGGTGATGCTGTCGCCGAAGAAGTTAAGAAAATCCTTGCTTAAAAAGATTCTCTTTT
TTTATGATATTTGTACATAAACTTTATAAATGAAATTCATAATAGAAACGACACGAAATT
ACAAAATGGAATATGTTCATAGGGTAGACGAAACTATATACGCAATCTACATACATTTAT
CAAGAAGGAGAAAAAGGAGGATAGTAAAGGAATACAGGTAAGCAAATTGATACTAATGGC
TCAACGTGATAAGGAAAAAGAATTGCACTTTAACATTAATATTGACAAGGAGGAGGGCAC
CACACAAAAAGTTAGGTGTAACAGAAAATCATGAAACTACGATTCCTAATTTGATATTGG
AGGATTTTCTCTAAAAAAAAAAAAAATACAACAAATAAAAAACACTCAATGACCTGACCAT
TTGATGGAGTTTAAGTCAATACCTTCTTGAACCATTTCCCATAATGGTGAAAGTTCCCTC
AAGAATTTTACTCTGTCAGAAACGGCCTTACGACGTAGTCGATATGGTGCACTCTCAGTA
CAATCTGCTCTGATGCCGCATAGTTAAGCCAGCCCCGACACCCGCCAACACCCGCTGACG
CGCCCTGACGGGCTTGTCTGCTCCCGGCATCCGCTTACAGACAAGCTGTGACCGTCTCCG
GGAGCTGCATGTGTCAGAGGTTTTCACCGTCATCACCGAAACGCGCGA
```

FIG.94F pDEST33 8815 bp

GCCTTACGCATCTGTGCGGTATTTCACACCGCAGGCAAGTGCACAAACAATACTTAAATA
AATACTACTCAGTAATAACCTATTTCTTAGCATTTTTGACGAAATTTGCTATTTTGTTAG
AGTCTTTTACACCATTTGTCTCCACACCTCCGCTTACATCAACACCAATAACGCCATTTA
ATCTAAGCGCATCACCAACATTTTCTGGCGTCAGTCCACCAGCTAACATAAAATGTAAGC
TTTCGGGGCTCTCTTGCCTTCCAACCCAGTCAGAAATCGAGTTCCAATCCAAAAGTTCAC
CTGTCCCACCTGCTTCTGAATCAAACAAGGGAATAAACGAATGAGGTTTCTGTGAAGCTG
CACTGAGTAGTATGTTGCAGTCTTTTGGAAATACGAGTCTTTTAATAACTGGCAAACCGA
GGAACTCTTGGTATTCTTGCCACGACTCATCTCCATGCAGTTGGACGATATCAATGCCGT
AATCATTGACCAGAGCCAAAACATCCTCCTTAGGTTGATTACGAAACACGCCAACCAAGT
ATTTCGGAGTGCCTGAACTATTTTTATATGCTTTTACAAGACTTGAAATTTTCCTTGCAA
TAACCGGGTCAATTGTTCTCTTTCTATTGGGCACACATATAATACCCAGCAAGTCAGCAT
CGGAATCTAGAGCACATTCTGCGGCCTCTGTGCTCTGCAAGCCGCAAACTTTCACCAATG
GACCAGAACTACCTGTGAAATTAATAACAGACATACTCCAAGCTGCCTTTGTGTGCTTAA
TCACGTATACTCACGTGCTCAATAGTCACCAATGCCCTCCCTCTTGGCCCTCTCCTTTTC
TTTTTTCGACCGAATTAATTCTTAATCGGCAAAAAAAGAAAAGCTCCGGATCAAGATTGT
ACGTAAGGTGACAAGCTATTTTTCAATAAAGAATATCTTCCACTACTGCCATCTGGCGTC
ATAACTGCAAAGTACACATATATTACGATGCTGTCTATTAAATGCTTCCTATATTATATA
TATAGTAATGTCGTTTATGGTGCACTCTCAGTACAATCTGCTCTGATGCCGCATAGTTAA
GCCAGCCCCGACACCCGCCAACACCCGCTGACGCGCCCTGACGGGCTTGTCTGCTCCCGG
CATCCGCTTACAGACAAGCTGTGACCGTCTCCGGGAGCTGCATGTGTCAGAGGTTTTCAC
CGTCATCACCGAAACGCGCGAGACGAAAGGGCCTCGTGATACGCCTATTTTTATAGGTTA
ATGTCATGATAATAATGGTTTCTTAGGACGGATCGCTTGCCTGTAACTTACACGCGCCTC
GTATCTTTTAATGATGGAATAATTTGGGAATTTACTCTGTGTTTATTTATTTTTATGTTT
TGTATTTGGATTTTAGAAAGTAAATAAAGAAGGTAGAAGAGTTACGGAATGAAGAAAAAA
AAATAAACAAAGGTTTAAAAAATTTCAACAAAAAGCGTACTTTACATATATATTTATTAG
ACAAGAAAAGCAGATTAAATAGATATACATTCGATTAACGATAAGTAAAATGTAAAATCA
CAGGATTTTCGTGTGTGGTCTTCTACACAGACAAGATGAAACAATTCGGCATTAATACCT
GAGAGCAGGAAGAGCAAGATAAAAGGTAGTATTTGTTGGCGATCCCCCTAGAGTCTTTTA
CATCTTCGGAAAACAAAAACTATTTTTTCTTTAATTTCTTTTTTTACTTTCTATTTTTAA
TTTATATATTTATATTAAAAAATTTAAATTATAATTATTTTTATAGCACGTGATGAAAAG
GACCCAGGTGGCACTTTTCGGGGAAATGTGCGCGGAACCCCTATTTGTTTATTTTTCTAA
ATACATTCAAATATGTATCCGCTCATGAGACAATAACCCTGATAAATGCTTCAATAATAT
TGAAAAAGGAAGAGTATGAGTATTCAACATTTCCGTGTCGCCCTTATTCCCTTTTTTGCG
GCATTTTGCCTTCCTGTTTTTGCTCACCCAGAAACGCTGGTGAAAGTAAAAGATGCTGAA
GATCAGTTGGGTGCACGAGTGGGTTACATCGAACTGGATCTCAACAGCGGTAAGATCCTT
GAGAGTTTTCGCCCCGAAGAACGTTTTCCAATGATGAGCACTTTTAAAGTTCTGCTATGT
GGCGCGGTATTATCCCGTATTGACGCCGGGCAAGAGCAACTCGGTCGCCGCATACACTAT
TCTCAGAATGACTTGGTTGAGTACTCACCAGTCACAGAAAAGCATCTTACGGATGGCATG

FIG.95B

```
ACAGTAAGAGAATTATGCAGTGCTGCCATAACCATGAGTGATAACACTGCGGCCAACTTA
CTTCTGACAACGATCGGAGGACCGAAGGAGCTAACCGCTTTTTTTCACAACATGGGGGAT
CATGTAACTCGCCTTGATCGTTGGGAACCGGAGCTGAATGAAGCCATACCAAACGACGAG
CGTGACACCACGATGCCTGTAGCAATGGCAACAACGTTGCGCAAACTATTAACTGGCGAA
CTACTTACTCTAGCTTCCCGGCAACAATTAATAGACTGGATGGAGGCGGATAAAGTTGCA
GGACCACTTCTGCGCTCGGCCCTTCCGGCTGGCTGGTTTATTGCTGATAAATCTGGAGCC
GGTGAGCGTGGGTCTCGCGGTATCATTGCAGCACTGGGGCCAGATGGTAAGCCCTCCCGT
ATCGTAGTTATCTACACGACGGGCAGTCAGGCAACTATGGATGAACGAAATAGACAGATC
GCTGAGATAGGTGCCTCACTGATTAAGCATTGGTAACTGTCAGACCAAGTTTACTCATAT
ATACTTTAGATTGATTTAAAACTTCATTTTTAATTTAAAAGGATCTAGGTGAAGATCCTT
TTTGATAATCTCATGACCAAAATCCCTTAACGTGAGTTTTCGTTCCACTGAGCGTCAGAC
CCCGTAGAAAAGATCAAAGGATCTTCTTGAGATCCTTTTTTTCTGCGCGTAATCTGCTGC
TTGCAAACAAAAAAACCACCGCTACCAGCGGTGGTTTGTTTGCCGGATCAAGAGCTACCA
ACTCTTTTTCCGAAGGTAACTGGCTTCAGCAGAGCGCAGATACCAAATACTGTCCTTCTA
GTGTAGCCGTAGTTAGGCCACCACTTCAAGAACTCTGTAGCACCGCCTACATACCTCGCT
CTGCTAATCCTGTTACCAGTGGCTGCTGCCAGTGGCGATAAGTCGTGTCTTACCGGGTTG
GACTCAAGACGATAGTTACCGGATAAGGCGCAGCGGTCGGGCTGAACGGGGGGTTCGTGC
ACACAGCCCAGCTTGGAGCGAACGACCTACACCGAACTGAGATACCTACAGCGTGAGCAT
TGAGAAAGCGCCACGCTTCCCGAAGGGAGAAAGGCGGACAGGTATCCGGTAAGCGGCAGG
GTCGGAACAGGAGAGCGCACGAGGGAGCTTCCAGGGGGGAACGCCTGGTATCTTTATAGT
CCTGTCGGGTTTCGCCACCTCTGACTTGAGCGTCGATTTTTGTGATGCTCGTCAGGGGGG
CCGAGCCTATGGAAAAACGCCAGCAACGCGGCCTTTTTACGGTTCCTGGCCTTTTGCTGG
CCTTTTGCTCACATGTTCTTTCCTGCGTTATCCCCTGATTCTGTGGATAACCGTATTACC
GCCTTTGAGTGAGCTGATACCGCTCGCCGCAGCCGAACGACCGAGCGCAGCGAGTCAGTG
AGCGAGGAAGCGGAAGAGCGCCCAATACGCAAACCGCCTCTCCCCGCGCGTTGGCCGATT
CATTAATGCAGCTGGCACGACAGGTTTCCCGACTGGAAAGCGGGCAGTGAGCGCAACGCA
ATTAATGTGAGTTACCTCACTCATTAGGCACCCCAGGCTTTACACTTTATGCTTCCGGCT
CCTATGTTGTGTGGAATTGTGAGCGGATAACAATTTCACACAGGAAACAGCTATGACCAT
GATTACGCCAAGCTCGGAATTAACCCTCACTAAAGGGAACAAAAGCTGGGTACCGGGCCC
CCCCTCGAGATCCGGGATCGAAGAAATGATGGTAAATGAAATAGGAAATCAAGGAGCATG
AAGGCAAAAGACAAATATAAGGGTCGAACGAAAAATAAAGTGAAAGTGTTGATATGATG
TATTTGGCTTTGCGGCGCCGAAAAAACGAGTTTACGCAATTGCACAATCATGCTGACTCT
GTGGCGGACCCGCGCTCTTGCCGGCCCGGCGATAACGCTGGGCGTGAGGCTGTGCCCGGC
GGAGTTTTTTGCGCCTGCATTTTCCAAGGTTTACCCTGCGCTAAGGGGCGAGATTGGAGA
AGCAATAAGAATGCCGGTTGGGGTTGCGATGATGACGACCACGACAACTGGTGTCATTAT
TTAAGTTGCCGAAAGAACCTGAGTGCATTTGCAACATGAGTATACTAGAAGAATGAGCCA
AGACTTGCGAGACGCGAGTTTGCCGGTGGTGCGAACAATAGAGCGACCATGACCTTGAAG
GTGAGACGCGCATAACCGCTAGAGTACTTTGAAGAGGAAACAGCAATAGGGTTGCTACCA
GTATAAATAGACAGGTACATACAACACTGGAAATGGTTGTCTGTTTGAGTACGCTTTCAA
TTCATTTGGGTGTGCACTTTATTATGTTACAATATGGAAGGGAACTTTACACTTCTCCTA
TGCACATATATTAATTAAAGTCCAATGCTAGTAGAGAAGGGGGGTAACACCCCTCCGCGC
```

FIG.95C

```
TCTTTTCCGATTTTTTTTCTAAACCGTGGAATATTTCGGATATCCTTTTGTTGTTTCCGGG
TGTACAATATGGACTTCCTCTTTTCTGGCAACCAAACCCATACATCGGGATTCCTATAAT
ACCTTCGTTGGTCTCCCTAACATGTAGGTGGCGGAGGGGAGATATACAATAGAACAGATA
CCAGACAAGACATAATGGGCTAAACAAGACTACACCAATTACACTGCCTCATTGATGGTG
GTACATAACGAACTAATACTGTAGCCCTAGACTTGATAGCCATCATCATATCGAAGTTTC
ACTACCCTTTTTCCATTTGCCATCTATTGAAGTAATAATAGGCGCATGCAACTTCTTTTC
TTTTTTTTTCTTTTCTCTCTCCCCGTTGTTGTCTCACCATATCCGCAATGACAAAAAAA
ATGATGGAAGACACTAAAGGAAAAAATTAACGACAAAGACAGCACCAACAGATGTCGTTG
TTCCAGAGCTGATGAGGGGTATCTTCGAACACACGAAACTTTTTCCTTCCTTCATTCACG
CACACTACTCTCTAATGAGCAACGGTATACGGCCTTCCTTCCAGTTACTTGAATTTGAAA
TAAAAAAAGTTTGCCGCTTTGCTATCAAGTATAAATAGACCTGCAATTATTAATCTTTTG
TTTCCTCGTCATTGTTCTCGTTCCCTTTCTTCCTTGTTTCTTTTTCTGCACAATATTTCA
AGCTATACCAAGCATACAATCAACTCCAAGCTTATGCCCAAGAAGAAGCGGAAGGTCTCG
AGCGGCGCCAATTTTAATCAAAGTGGGAATATTGCTGATAGCTCATTGTCCTTCACTTTC
ACTAACAGTAGCAACGGTCCGAACCTCATAACAACTCAAACAAATTCTCAAGCGCTTTCA
CAACCAATTGCCTCCTCTAACGTTCATGATAACTTCATGAATAATGAAATCACGGCTAGT
AAAATTGATGATGGTAATAATTCAAAACCACTGTCACCTGGTTGGACGGACCAAACTGCG
TATAACGCGTTTGGAATCACTACAGGGATGTTTAATACCACTACAATGGATGATGTATAT
AACTATCTATTCGATGATGAAGATACCCCACCAAACCCAAAAAAAGAGGGTGGGTCGAAT
CAAACAAGTTTGTACAAAAAAGCTGAACGAGAAACGTAAAATGATATAAATATCAATATA
TTAAATTAGATTTTGCATAAAAAACAGACTACATAATACTGTAAAACACAACATATCCAG
TCACTATGGCGGCCGCTAAGTTGGCAGCATCACCCGACGCACTTTGCGCCGAATAAATAC
CTGTGACGGAAGATCACTTCGCAGAATAAATAAATCCTGGTGTCCCTGTTGATACCGGGA
AGCCCTGGGCCAACTTTTGGCGAAAATGAGACGTTGATCGGCACGTAAGAGGTTCCAACT
TTCACCATAATGAAATAAGATCACTACCGGGCGTATTTTTTGAGTTATCGAGATTTTCAG
GAGCTAAGGAAGCTAAAATGGAGAAAAAAATCACTGGATATACCACCGTTGATATATCCC
AATGGCATCGTAAAGAACATTTTGAGGCATTTCAGTCAGTTGCTCAATGTACCTATAACC
AGACCGTTCAGCTGGATATTACGGCCTTTTTAAAGACCGTAAAGAAAAATAAGCACAAGT
TTTATCCGGCCTTTATTCACATTCTTGCCCGCCTGATGAATGCTCATCCGGAATTCCGTA
TGGCAATGAAAGACGGTGAGCTGGTGATATGGGATAGTGTTCACCCTTGTTACACCGTTT
TCCATGAGCAAACTGAAACGTTTTCATCGCTCTGGAGTGAATACCACGACGATTTCCGGC
AGTTTCTACACATATATTCGCAAGATGTGGCGTGTTACGGTGAAAACCTGGCCTATTTCC
CTAAAGGGTTTATTGAGAATATGTTTTTCGTCTCAGCCAATCCCTGGGTGAGTTTCACCA
GTTTTGATTTAAACGTGGCCAATATGGACAACTTCTTCGCCCCCGTTTTCACCATGGGCA
AATATTATACGCAAGGCGACAAGGTGCTGATGCCGCTGGCGATTCAGGTTCATCATGCCG
TCTGTGATGGCTTCCATGTCGGCAGAATGCTTAATGAATTACAACAGTACTGCGATGAGT
GGCAGGGCGGGGCGTAATCTAGAGGATCCGGCTTACTAAAAGCCAGATAACAGTATGCGT
ATTTGCGCGCTGATTTTTGCGGTATAAGAATATATACTGATATGTATACCCGAAGTATGT
CAAAAAGAGGTGTGCTATGAAGCAGCGTATTACAGTGACAGTTGACAGCGACAGCTATCA
GTTGCTCAAGGCATATATGATGTCAATATCTCCGGTCTGGTAAGCACAACCATGCAGAAT
GAAGCCCGTCGTCTGCGTGCCGAACGCTGGAAAGCGGAAAATCAGGAAGGGATGGCTGAG
```

FIG.95D

```
GTCGCCCGGTTTATTGAAATGAACGGCTCTTTTGCTGACGAGAACAGGGACTGGTGAAAT
GCAGTTTAAGGTTTACACCTATAAAAGAGAGAGCCGTTATCGTCTGTTTGTGGATGTACA
GAGTGATATTATTGACACGCCCGGGCGACGGATGGTGATCCCCCTGGCCAGTGCACGTCT
GCTGTCAGATAAAGTCTCCCGTGAACTTTACCCGGTGGTGCATATCGGGGATGAAAGCTG
GCGCATGATGACCACCGATATGGCCAGTGTGCCGGTCTCCGTTATCGGGGAAGAAGTGGC
TGATCTCAGCCACCGCGAAAATGACATCAAAAACGCCATTAACCTGATGTTCTGGGGAAT
ATAAATGTCAGGCTCCGTTATACACAGCCAGTCTGCAGGTCGACCATAGTGACTGGATAT
GTTGTGTTTTACAGTATTATGTAGTCTGTTTTTTATGCAAAATCTAATTTAATATATTGA
TATTTATATCATTTTACGTTTCTCGTTCAGCTTTCTTGTACAAAGTGGTTTGATGGCCGC
TAAGTAAGTAAGACGTCGAGCTCCCTATAGTGAGTCGTATTACACTGGCCGTCGTTTTAC
AACGTCGTGACTGGGAAAACACCGGTGAGCTCTAAGTAAGTAACGGCCGCCACCGCGGTG
GAGCTTTGGACTTCTTCGCCAGAGGTTTGGTCAAGTCTCCAATCAAGGTTGTCGGCTTGT
CTACCTTGCCAGAAATTTACGAAAAGATGGAAAAGGGTCAAATCGTTGGTAGATACGTTG
TTGACACTTCTAAATAAGCGAATTTCTTATGATTTATGATTTTTATTATTAAATAAGTTA
TAAAAAAAATAAGTGTATACAAATTTTAAAGTGACTCTTAGGTTTTAAAACGAAAATTCT
TGTTCTTGAGTAACTCTTTCCTGTAGGTCAGGTTGCTTTCTCAGGTATAGCATGAGGTCG
CTCTTATTGACCACACCTCTACCGGCATGCCGAGCAAATGCCTGCAAATCGCTCCCCATT
TCACCCAATTGTAGATATGCTAACTCCAGCAATGAGTTGATGAATCTCGGTGTGTATTTT
ATGTCCTCAGAGGACAATACCTGTTGTAATCGTTCTTCCACACGGATCCGCATCAGGCGA
AATTGTAAACGTTAATATTTTGTTAAAATTCGCGTTAAATATTTGTTAAATCAGCTCATT
TTTTAACCAATAGGCCGAAATCGGCAAAATCCCTTATAAATCAAAAGAATAGACCGAGAT
AGGGTTGAGTGTTGTTCCAGTTTGGAACAAGAGTCCACTATTAAAGAACGTGGACTCCAA
CGTCAAAGGGCGAAAAACCGTCTATCAGGGCGATGGCCCACTACGTGAACCATCACCCTA
ATCAAGTTTTTTGGGGTCGAGGTGCCGTAAAGCACTAAATCGGAACCCTAAAGGGAGCCC
CCGATTTAGAGCTTGACGGGGAAAGCCGGCGAACGTGGCGAGAAAGGAAGGGAAGAAAGC
GAAAGGAGCGGGCGCTAGGGCGCTGGCAAGTGTAGCGGTCACGCTGCGCGTAACCACCAC
ACCCGCCGCGCTTAATGCGCCGCTACAGGGCGCGTCCCATTCGCCATTCACTGCA
```

FIG.95E pDEST34 7114 bp

| Location (Base Nos.) | Gene Encoded |
|---|---|
| 195..71 | attR1 |
| 304..963 | CmR |
| 1305..1610 | ccdB |
| 1651..1775 | attR2 |
| 1780..2472 | GST |
| 2675..2720 | T7stop |
| 3334..4194 | ampR |
| 4343..4982 | ori |

```
ATCGAGATCTCGATCCCGCGAAATTAATACGACTCACTATAGGGAGACCACAACGGTTTC
CCTCTAGATCACAAGTTTGTACAAAAAAGCTGAACGAGAAACGTAAAATGATATAAATAT
CAATATATTAAATTAGATTTTGCATAAAAAACAGACTACATAATACTGTAAAACACAACA
TATCCAGTCACTATGGCGGCCGCATTAGGCACCCCAGGCTTTACACTTTATGCTTCCGGC
TCGTATAATGTGTGGATTTTGAGTTAGGATCCGGCGAGATTTTCAGGAGCTAAGGAAGCT
AAAATGGAGAAAAAAATCACTGGATATACCACCGTTGATATATCCCAATGGCATCGTAAA
GAACATTTTGAGGCATTTCAGTCAGTTGCTCAATGTACCTATAACCAGACCGTTCAGCTG
GATATTACGGCCTTTTTTAAAGACCGTAAAGAAAAATAAGCACAAGTTTTATCCGGCCTTT
ATTCACATTCTTGCCCGCCTGATGAATGCTCATCCGGAATTCCGTATGGCAATGAAAGAC
GGTGAGCTGGTGATATGGGATAGTGTTCACCCTTGTTACACCGTTTTCCATGAGCAAACT
GAAACGTTTTCATCGCTCTGGAGTGAATACCACGACGATTTCCGGCAGTTTCTACACATA
TATTCGCAAGATGTGGCGTGTTACGGTGAAAACCTGGCCTATTTCCCTAAAGGGTTTATT
GAGAATATGTTTTTCGTCTCAGCCAATCCCTGGGTGAGTTTCACCAGTTTTGATTTAAAC
GTGGCCAATATGGACAACTTCTTCGCCCCCGTTTTCACCATGGGCAAATATTATACGCAA
GGCGACAAGGTGCTGATGCCGCTGGCGATTCAGGTTCATCATGCCGTCTGTGATGGCTTC
CATGTCGGCAGAATGCTTAATGAATTACAACAGTACTGCGATGAGTGGCAGGGCGGGGCG
TAAACGCGTGGATCCGGCTTACTAAAAGCCAGATAACAGTATGCGTATTTGCGCGCTGAT
TTTTGCGGTATAAGAATATATACTGATATGTATACCCGAAGTATGTCAAAAAGAGGTGTG
CTATGAAGCAGCGTATTACAGTGACAGTTGACAGCGACAGCTATCAGTTGCTCAAGGCAT
ATATGATGTCAATATCTCCGGTCTGGTAAGCACAACCATGCAGAATGAAGCCCGTCGTCT
GCGTGCCGAACGCTGGAAAGCGGAAAATCAGGAAGGGATGGCTGAGGTCGCCCGGTTTAT
TGAAATGAACGGCTCTTTTGCTGACGAGAACAGGGACTGGTGAAATGCAGTTTAAGGTTT
ACACCTATAAAAGAGAGAGCCGTTATCGTCTGTTTGTGGATGTACAGAGTGATATTATTG
ACACGCCCGGGCGACGGATGGTGATCCCCCTGGCCAGTGCACGTCTGCTGTCAGATAAAG
TCTCCCGTGAACTTTACCCGGTGGTGCATATCGGGGATGAAAGCTGGCGCATGATGACCA
CCGATATGGCCAGTGTGCCGGTCTCCGTTATCGGGGAAGAAGTGGCTGATCTCAGCCACC
GCGAAAATGACATCAAAAACGCCATTAACCTGATGTTCTGGGGAATATAAATGTCAGGCT
CCCTTATACACAGCCAGTCTGCAGGTCGACCATAGTGACTGGATATGTTGTGTTTTACAG
TATTATGTAGTCTGTTTTTTTATGCAAAATCTAATTTAATATATTGATATTTATATCATTT
TACGTTTCTCGTTCAGCTTTCTTGTACAAAGTGGTGATTATGTCCCTATACTAGGTTAT
TGGAAAATTAAGGGCCTTGTGCAACCCACTCGACTTCTTTTGGAATATCTTGAAGAAAAA
TATGAAGAGCATTTGTATGAGCGCGATGAAGGTGATAAATGGCGAAACAAAAAGTTTGAA
```

FIG.96B

```
TTGGGTTTGGAGTTTCCCAATCTTCCTTATTATATTGATGGTGATGTTAAATTAACACAG
TCTATGGCCATCATACGTTATATAGCTGACAAGCACAACATGTTGGGTGGTTGTCCAAAA
GAGCGTGCAGAGATTTCAATGCTTGAAGGAGCGGTTTTGGATATTAGATACGGTGTTTCG
AGAATTGCATATAGTAAAGACTTTGAAACTCTCAAAGTTGATTTTCTTAGCAAGCTACCT
GAAATGCTGAAAATGTTCGAAGATCGTTTATGTCATAAAACATATTTAAATGGTGATCAT
GTAACCCATCCTGACTTCATGTTGTATGACGCTCTTGATGTTGTTTTATACATGGACCCA
ATGTGCCTGGATGCGTTCCCAAAATTAGTTTGTTTTAAAAAACGTATTGAAGCTATCCCA
CAAATTGATAAGTACTTGAAATCCAGCAAGTATATAGCATGGCCTTTGCAGGGCTGGCAA
GCCACGTTTGGTGGTGGCGACCATCCTCCAAAATCGGATCTGGTTCCGCGTCCATGGGGA
TCCGGCTGCTAACAAAGCCCGAAAGGAAGCTGAGTTGGCTGCTGCCACCGCTGAGCGCTT
CCCGATAAGGGAGCAGGCCAGTAAAAGCATTACCCGTGGTGGGGTTCCCGAGCGGCCAAA
GGGAGCAGACTCTAAATCTGCCGTCATCGACTTCGAAGGTTCGAATCCTTCCCCCACCAC
CATCACTTTCAAAAGTGAATTCGCTGAGCAATAACTAGCATAACCCCTTGGGGCCTCTAA
ACGGGTCTTGAGGGGTTTTTTGCTGAAAGGAGGAACTATATCCGGATATCCACAGGACGG
GTGTGGTCGCCATGATCGCGTAGTCGATAGTGGCTCCAAGTAGCGAAGCGAGCAGGACTG
GGCGGCGGCCAAAGCGGTCGGACAGTGCTCCGAGAACGGGTGCGCATAGAAATTGCATCA
ACGCATATAGCGCTAGCAGCACGCCATAGTGACTGGCGATGCTGTCGGAATGGACGATAT
CCCGCAAGAGGCCCGGCAGTACCGGCATAACCAAGCCTATGCCTACAGCATCCAGGGTGA
CGGTGCCGAGGATGACGATGAGCGCATTGTTAGATTTCATACACGGTGCCTGACTGCGTT
AGCAATTTAACTGTGATAAACTACCGCATTAAAGCTTATCGATGATAAGCTGTCAAACAT
GAGAATTCTTGAAGACGAAAGGGCCTCGTGATACGCCTATTTTTATAGGTTAATGTCATG
ATAATAATGGTTTCTTAGACGTCAGGTGGCACTTTTCGGGGAAATGTGCGCGGAACCCCT
ATTTGTTTATTTTTCTAAATACATTCAAATATGTATCCGCTCATGAGACAATAACCCTGA
TAAATGCTTCAATAATATTGAAAAAGGAAGAGTATGAGTATTCAACATTTCCGTGTCGCC
CTTATTCCCTTTTTTGCGGCATTTTGCCTTCCTGTTTTTGCTCACCCAGAAACGCTGGTG
AAAGTAAAAGATGCTGAAGATCAGTTGGGTGCACGAGTGGGTTACATCGAACTGGATCTC
AACAGCGGTAAGATCCTTGAGAGTTTTCGCCCCGAAGAACGTTTTCCAATGATGAGCACT
TTTAAAGTTCTGCTATGTGGCGCGGTATTATCCCGTGTTGACGCCGGGCAAGAGCAACTC
GGTCGCCGCATACACTATTCTCAGAATGACTTGGTTGAGTACTCACCAGTCACAGAAAAG
CATCTTACGGATGGCATGACAGTAAGAGAATTATGCAGTGCTGCCATAACCATGAGTGAT
AACACTGCGGCCAACTTACTTCTGACAACGATCGGAGGACCGAAGGAGCTAACCGCTTTT
TTGCACAACATGGGGGATCATGTAACTCGCCTTGATCGTTGGGAACCGGAGCTGAATGAA
GCCATACCAAACGACGAGCGTGACACCACGATGCCTGCAGCAATGGCAACAACGTTGCGC
AAACTATTAACTGGCGAACTACTTACTCTAGCTTCCCGGCAACAATTAATAGACTGGATG
GAGGCGGATAAAGTTGCAGGACCACTTCTGCGCTCGGCCCTTCCGGCTGGCTGGTTTATT
GCTGATAAATCTGGAGCCGGTGAGCGTGGGTCTCGCGGTATCATTGCAGCACTGGGGCCA
GATGGTAAGCCCTCCCGTATCGTAGTTATCTACACGACGGGGAGTCAGGCAACTATGGAT
GAACGAAATAGACAGATCGCTGAGATAGGTGCCTCACTGATTAAGCATTGGTAACTGTCA
GACCAAGTTTACTCATATATACTTTAGATTGATTTAAAACTTCATTTTTAATTTAAAAGG
ATCTAGGTGAAGATCCTTTTTGATAATCTCATGACCAAAATCCCTTAACGTGAGTTTTCG
TTCCACTGAGCGTCAGACCCCGTAGAAAAGATCAAAGGATCTTCTTGAGATCCTTTTTTT
CTGCGCGTAATCTGCTGCTTGCAAACAAAAAAACCACCGCTACCAGCGGTGGTTTGTTTG
CCGGATCAAGAGCTACCAACTCTTTTTCCGAAGGTAACTGGCTTCAGCAGAGCGCAGATA
CCAAATACTGTCCTTCTAGTGTAGCCGTAGTTAGGCCACCACTTCAAGAACTCTGTAGCA
CCGCCTACATACCTCGCTCTGCTAATCCTGTTACCAGTGGCTGCTGCCAGTGGCGATAAG
TCGTGTCTTACCGGGTTGGACTCAAGACGATAGTTACCGGATAAGGCGCAGCGGTCGGGC
```

FIG.96C

```
TGAACGGGGGGTTCGTGCACACAGCCCAGCTTGGAGCGAACGACCTACACCGAACTGAGA
TACCTACAGCGTGAGCTATGAGAAAGCGCCACGCTTCCCGAAGGGAGAAAGGCGGACAGG
TATCCGGTAAGCGGCAGGGTCGGAACAGGAGAGCGCACGAGGGAGCTTCCAGGGGGAAAC
GCCTGGTATCTTTATAGTCCTGTCGGGTTTCGCCACCTCTGACTTGAGCGTCGATTTTTG
TGATGCTCGTCAGGGGGGCGGAGCCTATGGAAAAACGCCAGCAACGCGGCCTTTTTACGG
TTCCTGGCCTTTTGCTGGCCTTTTGCTCACATGTTCTTTCCTGCGTTATCCCCTGATTCT
GTGGATAACCGTATTACCGCCTTTGAGTGAGCTGATACCGCTCGCCGCAGCCGAACGACC
GAGCGCAGCGAGTCAGTGAGCGAGGAAGCGGAAGAGCGCCTGATGCGGTATTTTCTCCTT
ACGCATCTGTGCGGTATTTCACACCGCATATATGGTGCACTCTCAGTACAATCTGCTCTG
ATGCCGCATAGTTAAGCCAGTATACACTCCGCTATCGCTACGTGACTGGGTCATGGCTGC
GCCCCGACACCCGCCAACACCCGCTGACGCGCCCTGACGGGCTTGTCTGCTCCCGGCATC
CGCTTACAGACAAGCTGTGACCGTCTCCGGGAGCTGCATGTGTCAGAGGTTTTCACCGTC
ATCACCGAAACGCGCGAGGCAGCTGCGGTAAAGCTCATCAGCGTGGTCGTGAAGCGATTC
ACAGATGTCTGCCTGTTCATCCGCGTCCAGCTCGTTGAGTTTCTCCAGAAGCGTTAATGT
CTGGCTTCTGATAAAGCGGGCCATGTTAAGGGCGGTTTTTTCCTGTTTGGTCACTGATGC
CTCCGTGTAAGGGGGATTTCTGTTCATGGGGGTAATGATACCGATGAAACGAGAGAGGAT
GCTCACGATACGGGTTACTGATGATGAACATGCCCGGTTACTGGAACGTTGTGAGGGTAA
ACAACTGGCGGTATGGATGCGGCGGGACCAGAGAAAAATCACTCAGGGTCAATGCCAGCG
CTTCGTTAATACAGATGTAGGTGTTCCACAGGGTAGCCAGCAGCATCCTGCGATGCAGAT
CCGGAACATAATGGTGCAGGGCGCTGACTTCCGCGTTTCCAGACTTTACGAAACACGGAA
ACCGAAGACCATTCATGTTGTTGCTCAGGTCGCAGACGTTTTGCAGCAGCAGTCGCTTCA
CGTTCGCTCGCGTATCGGTGATTCATTCTGCTAACCAGTAAGGCAACCCCGCCAGCCTAG
CCGGGTCCTCAACGACAGGAGCACGATCATGCGCACCCGTGGCCAGGACCCAACGCTGCC
CGAGATGCGCCGCGTGCGGCTGCTGGAGATGGCGGACGCGATGGATATGTTCTGCCAAGG
GTTGGTTTGCGCATTCACAGTTCTCCGCAAGAATTGATTGGCTCCAATTCTTGGAGTGGT
GAATCCGTTAGCGAGGTGCCGCCGGCTTCCATTCAGGTCGAGGTGGCCCGGCTCCATGCA
CCGCGACGCAACGCGGGGAGGCAGACAAGGTATAGGGCGGCGCCTACAATCCATGCCAAC
CCGTTCCATGTGCTCGCCGAGGCGGCATAAATCGCCGTGACGATCAGCGGTCCAGTGATC
GAAGTTAGGCTGGTAAGAGCCGCGAGCGATCCTTGAAGCTGTCCCTGATGGTCGTCATCT
ACCTGCCTGGACAGCATGGCCTGCAACGCGGGCATCCCGATGCCGCCGGAAGCGAGAAGA
ATCATAATGGGGAAGGCCATCCAGCCTCGCGTCGCGAACGCCAGCAAGACGTAGCCCAGC
GCGTCGGCCGCCATGCCGGCGATAATGGCCTGCTTCTCGCCGAAACGTTTGGTGGCGGGA
CCAGTGACGAAGGCTTGAGCGAGGGCGTGCAAGATTCCGAATACCGCAAGCGACAGGCCG
ATCATCGTCGCGCTCCAGCGAAAGCGGTCCTCGCCGAAAATGACCCAGAGCGCTGCCGGC
ACCTGTCCTACGAGTTGCATGATAAAGAAGACAGTCATAAGTGCGGCGACGATAGTCATG
CCCCGCGCCCACCGGAAGGAGCTGACTGGGTTGAAGGCTCTCAAGGGCATCGGTCGATCG
ACGCTCTCCCTTATGCGACTCCTGCATTAGGAAGCAGCCCAGTAGTAGGTTGAGGCCGTT
GAGCACCGCCGCCGCAAGGAATGGTGCATGCAAGGAGATGGCGCCCAACAGTCCCCCGGC
CACGGGGCCTGCCACCATACCCACGCCGAAACAAGCGCTCATGAGCCCGAAGTGGCGAGC
CCGATCTTCCCCATCGGTGATGTCGGCGATATAGGCGCCAGCAACCGCACCTGTGGCGCC
GGTGATGCCGGCCACGATGCGTCCGGCGTAGAGG
```

FIG.96D pDONR207 5584 bp

```
GCGAGAGTAGGGAACTGCCAGGCATCAAATAAAACGAAAGGCTCAGTCGGAAGACTGGGC
CTTTCGTTTTATCTGTTGTTTGTCGGTGAACGCTCTCCTGAGTAGGACAAATCCGCCGGG
AGCGGATTTGAACGTTGTGAAGCAACGGCCCGGAGGGTGGCGGGCAGGACGCCCGCCATA
AACTGCCAGGCATCAAACTAAGCAGAAGGCCATCCTGACGGATGGCCTTTTTTGCGTTTCT
ACAAACTCTTCCTGGCTAGCGGTAATACGGTTATCCACAGAATCAGGGGATAACGCAGGA
AAGAACATGTGAGCAAAAGGCCAGCAAAAGGCCAGGAACCGTAAAAAGGCCGCGTTGCTG
GCGTTTTTCCATAGGCTCCGCCCCCCTGACGAGCATCACAAAAATCGACGCTCAAGTCAG
AGGTGGCGAAACCCGACAGGACTATAAAGATACCAGGCGTTTCCCCCTGGAAGCTCCCTC
GTGCGCTCTCCTGTTCCGACCCTGCCGCTTACCGGATACCTGTCCGCCTTTCTCCCTTCG
GGAAGCGTGGCGCTTTCTCATAGCTCACGCTGTAGGTATCTCAGTTCGGTGTAGGTCGTT
CGCTCCAAGCTGGGCTGTGTGCACGAACCCCCCGTTCAGCCCGACCGCTGCGCCTTATCC
GGTAACTATCGTCTTGAGTCCAACCCGGTAAGACACGACTTATCGCCACTGGCAGCAGCC
ACTGGTAACAGGATTAGCAGAGCGAGGTATGTAGGCGGTGCTACAGAGTTCTTGAAGTGG
TGGCCTAACTACGGCTACACTAGAAGGACAGTATTTGGTATCTGCGCTCTGCTGAAGCCA
GTTACCTTCGGAAAAAGAGTTGGTAGCTCTTGATCCGGCAAACAAACCACCGCTGGTAGC
GGTGGTTTTTTTGTTTGCAAGCAGCAGATTACGCGCAGAAAAAAAGGATCTCAAGAAGAT
CCTTTGATCTTTTCTACGGGGTCTGACGCTCAGTGGAACGAAAACTCACGTTAAGGGATT
TTGGTCATGAGCTTGCGCCGTCCCGTCAAGTCAGCGTAATGCTCTGCCAGTGTTACAACC
AATTAACCAATTCTGATTAGAAAAACTCATCGAGCATCAAATGAAACTGCAATTTATTCA
TATCAGGATTATCAATACCATATTTTTGAAAAAGCCGTTTCTGTAATGAAGGAGAAAACT
CACCGAGGCAGTTCCATAGGATGGCAAGATCCTGGTATCGGTCTGCGATTCCGACTCGTC
CAACATCAATACAACCTATTAGTAGCCAACCACTAGAACTATAGCTAGAGTCCTGGGCGA
ACAAACGATGCTCGCCTTCCAGAAAACCGAGGATGCGAACCACTTCATCCGGGGTCAGCA
CCACCGGCAAGCGCCGCGACGGCCGAGGTCTTCCGATCTCCTGAAGCCAGGGCAGATCCG
TGCACAGCACCTTGCCGTAGAAGAACAGCAAGGCCGCCAATGCCTGACGATGCGTGGAGA
CCGAAACCTTGCGCTCGTTCGCCAGCCAGGACAGAAATGCCTCGACTTCGCTGCTGCCCA
AGGTTGCCGGGTGACGCACACCGTGGAAACGGATGAAGGCACGAACCCAGTTGACATAAG
CCTGTTCGGTTCGTAAACTGTAATGCAAGTAGCGTATGCGCTCACGCAACTGGTCCAGAA
CCTTGACCGAACGCAGCGGTGGTAACGGCGCAGTGGCGGTTTTCATGGCTTGTTATGACT
GTTTTTTTGTACAGTCTATGCCTCGGGCATCCAAGCAGCAAGCGCGTTACGCCGTGGGTC
GATGTTTGATGTTATGGAGCAGCAACGATGTTACGCAGCAGCAACGATGTTACGCAGCAG
GGCAGTCGCCCTAAAACAAAGTTAGGTGGCTCAAGTATGGGCATCATTCGCACATGTAGG
CTCGGCCCTGACCAAGTCAAATCCATGCGGGCTGCTCTTGATCTTTTCGGTCGTGAGTTC
GGAGACGTAGCCACCTACTCCCAACATCAGCCGGACTCCGATTACCTCGGGAACTTGCTC
CGTAGTAAGACATTCATCGCGCTTGCTGCCTTCGACCAAGAAGCGGTTGTTGGCGCTCTC
GCGGCTTACGTTCTGCCCAGGTTTGAGCAGCCGCGTAGTGAGATCTATATCTATGATCTC
GCAGTCTCCGGCGAGCACCGGAGGCAGGGCATTGCCACCGCGCTCATCAATCTCCTCAAG
CATGAGGCCAACGCGCTTGGTGCTTATGTGATCTACGTGCAAGCAGATTACGGTGACGAT
CCCGCAGTGGCTCTCTATACAAAGTTGGGCATACGGGAAGAAGTGATGCACTTTGATATC
GACCCAAGTACCGCCACCTAACAATTCGTTCAAGCCGAGATCGGCTTCCCGGCCTAATTT
CCCCTCGTCAAAAATAAGGTTATCAAGTGAGAAATCACCATGAGTGACGACTGAATCCGG
TGAGAATGGCAAAAGTTTATGCATTTCTTTCCAGACTTGTTCAACAGGCCAGCCATTACG
CTCGTCATCAAAATCACTCGCATCAACCAAACCGTTATTCATTCGTGATTGCGCCTGAGC
GAGACGAAATACGCGATCGCTGTTAAAAGGACAATTACAAACAGGAATCGAATGCAACCG
GCGCAGGAACACTGCCAGCGCATCAACAATATTTTCACCTGAATCAGGATATTCTTCTAA
TACCTGGAATGCTGTTTTTCCGGGGATCGCAGTGGTGAGTAACCATGCATCATCAGGAGT
ACGGATAAAATGCTTGATGGTCGGAAGAGGCATAAATTCCGTCAGCCAGTTTAGTCTGAC
CATCTCATCTGTAACATCATTGGCAACGCTACCTTTGCCATGTTTCAGAAACAACTCTGG
```

FIG.97B

```
CGCATCGGGCTTCCCATACAAGCGATAGATTGTCGCACCTGATTGCCCGACATTATCGCG
AGCCCATTTATACCCATATAAATCAGCATCCATGTTGGAATTTAATCGCGGCCTCGACGT
TTCCCGTTGAATATGGCTCATAACACCCCCTGTATTACTGTTTATGTAAGCAGACAGTTT
TATTGTTCATGATGATATATTTTTATCTTGTGCAATGTAACATCAGAGATTTTGAGACAC
GGGCCAGAGCTGCAGCTGGATGGCAAATAATGATTTTATTTTGACTGATAGTGACCTGTT
CGTTGCAACAAATTGATAAGCAATGCTTTCTTATAATGCCAACTTTGTACAAGAAAGCTG
AACGAGAAACGTAAAATGATATAAATATCAATATATTAAATTAGATTTTGCATAAAAAAC
AGACTACATAATACTGTAAAACACAACATATCCAGTCACTATGAATCAACTACTTAGATG
GTATTAGTGACCTGTAGTCGACTAAGTTGGCAGCATCACCCGACGCACTTTGCGCCGAAT
AAATACCTGTGACGGAAGATCACTTCGCAGAATAAATAAATCCTGGTGTCCCTGTTGATA
CCGGGAAGCCCTGGGCCAACTTTGGCGAAAATGAGACGTTGATCGGCACGTAAGAGGTTC
CAACTTTCACCATAATGAAATAAGATCACTACCGGGCGTATTTTTTGAGTTATCGAGATT
TTCAGGAGCTAAGGAAGCTAAAATGGAGAAAAAAATCACTGGATATACCACCGTTGATAT
ATCCCAATGGCATCGTAAAGAACATTTTGAGGCATTTCAGTCAGTTGCTCAATGTACCTA
TAACCAGACCGTTCAGCTGGATATTACGGCCTTTTTAAAGACCGTAAAGAAAAATAAGCA
CAAGTTTTATCCGGCCTTTATTCACATTCTTGCCCGCCTGATGAATGCTCATCCGGAATT
CCGTATGGCAATGAAAGACGGTGAGCTGGTGATATGGGATAGTGTTCACCCTTGTTACAC
CGTTTTCCATGAGCAAACTGAAACGTTTTCATCGCTCTGGAGTGAATACCACGACGATTT
CCGGCAGTTTCTACACATATATTCGCAAGATGTGGCGTGTTACGGTGAAAACCTGGCCTA
TTTCCCTAAAGGGTTTATTGAGAATATGTTTTTCGTCTCAGCCAATCCCTGGGTGAGTTT
CACCAGTTTTGATTTAAACGTGGCCAATATGGACAACTTCTTCGCCCCCGTTTTCACCAT
GGGCAAATATTATACGCAAGGCGACAAGGTGCTGATGCCGCTGGCGATTCAGGTTCATCA
TGCCGTCTGTGATGGCTTCCATGTCGGCAGAATGCTTAATGAATTACAACAGTACTGCGA
TGAGTGGCAGGGCGGGGCGTAATCGCGTGGATCCGGCTTACTAAAAGCCAGATAACAGTA
TGCGTATTTGCGCGCTGATTTTTGCGGTATAAGAATATATACTGATATGTATACCCGAAG
TATGTCAAAAAGAGGTGTGCTATGAAGCAGCGTATTACAGTGACAGTTGACAGCGACAGC
TATCAGTTGCTCAAGGCATATATGATGTCAATATCTCCGGTCTGGTAAGCACAACCATGC
AGAATGAAGCCCGTCGTCTGCGTGCCGAACGCTGGAAAGCGGAAAATCAGGAAGGGATGG
CTGAGGTCGCCCGGTTTATTGAAATGAACGGCTCTTTTGCTGACGAGAACAGGGACTGGT
GAAATGCAGTTTAAGGTTTACACCTATAAAAGAGAGAGCCGTTATCGTCTGTTTGTGGAT
GTACAGAGTGATATTATTGACACGCCCGGGCGACGGATGGTGATCCCCCTGGCCAGTGCA
CGTCTGCTGTCAGATAAAGTCTCCCGTGAACTTTACCCGGTGGTGCATATCGGGGATGAA
AGCTGGCGCATGATGACCACCGATATGGCCAGTGTGCCGGTCTCCGTTATCGGGGAAGAA
GTGGCTGATCTCAGCCACCGCGAAAATGACATCAAAAACGCCATTAACCTGATGTTCTGG
GGAATATAAATGTCAGGCTCCCTTATACACAGCCAGTCTGCAGGTCGATACAGTAGAAAT
TACAGAAACTTTATCACGTTTAGTAAGTATAGAGGCTGAAAATCCAGATGAAGCCGAACG
ACTTGTAAGAGAAAAGTATAAGAGTTGTGAAATTGTTCTTGATGCAGATGATTTTCAGGA
CTATGACACTAGCGTATATGAATAGGTAGATGTTTTTATTTTGTCACACAAAAAAGAGGC
TCGCACCTCTTTTTTCTTATTTCTTTTTATGATTTAATACGGCATTGAGGACAATAGCGAG
TAGGCTGGATACGACGATTCCGTTTGAGAAGAACATTTGGAAGGCTGTCGGTCGACTAAG
TTGGCAGCATCACCCGAAGAACATTTGGAAGGCTGTCGGTCGACTACAGGTCACTAATAC
CATCTAAGTAGTTGATTCATAGTGACTGGATATGTTGTTTTACAGTATTATGTAGTCT
GTTTTTTATGCAAAATCTAATTTAATATATTGATATTTATATCATTTTACGTTTCTCGTT
CAGCTTTTTTGTACAAAGTTGGCATTATAAAAAGCATTGCTCATCAATTTGTTGCAACG
AACAGGTCACTATCAGTCAAAATAAAATCATTATTTGGGGCCCGAGATCCATGCTAGCGT
TAAC
```

FIG.97C pMAB85 7038 bp

```
GCCTTACGCATCTGTGCGGTATTTCACACCGCAGGCAAGTGCACAAACAATACTTAAATA
AATACTACTCAGTAATAACCTATTTCTTAGCATTTTTGACGAAATTTGCTATTTTGTTAG
AGTCTTTTACACCATTTGTCTCCACACCTCCGCTTACATCAACACCAATAACGCCATTTA
ATCTAAGCGCATCACCAACATTTTCTGGCGTCAGTCCACCAGCTAACATAAAATGTAAGC
TTTCGGGGCTCTCTTGCCTTCCAACCCAGTCAGAAATCGAGTTCCAATCCAAAAGTTCAC
CTGTCCCACCTGCTTCTGAATCAAACAAGGGAATAAACGAATGAGGTTTCTGTGAAGCTG
CACTGAGTAGTATGTTGCAGTCTTTTGGAAATACGAGTCTTTTAATAACTGGCAAACCGA
GGAACTCTTGGTATTCTTGCCACGACTCATCTCCATGCAGTTGGACGATATCAATGCCGT
AATCATTGACCAGAGCCAAAACATCCTCCTTAGGTTGATTACGAAACACGCCAACCAAGT
ATTTCGGAGTGCCTGAACTATTTTTATATGCTTTTACAAGACTTGAAATTTTCCTTGCAA
TAACCGGGTCAATTGTTCTCTTTCTATTGGGCACACATATAATACCCAGCAAGTCAGCAT
CGGAATCTAGAGCACATTCTGCGGCCTCTGTGCTCTGCAAGCCGCAAACTTTCACCAATG
GACCAGAACTACCTGTGAAATTAATAACAGACATACTCCAAGCTGCCTTTGTGTGCTTAA
TCACGTATACTCACGTGCTCAATAGTCACCAATGCCCTCCCTCTTGGCCCTCTCCTTTTC
TTTTTTCGACCGAATTAATTCTTAATCGGCAAAAAAGAAAAGCTCCGGATCAAGATTGT
ACGTAAGGTGACAAGCTATTTTTCAATAAAGAATATCTTCCACTACTGCCATCTGGCGTC
ATAACTGCAAAGTACACATATATTACGATGCTGTCTATTAAATGCTTCCTATATTATATA
TATAGTAATGTCGTTTATGGTGCACTCTCAGTACAATCTGCTCTGATGCCGCATAGTTAA
GCCAGCCCCGACACCCGCCAACACCCGCTGACGCGCCCTGACGGGCTTGTCTGCTCCCGG
CATCCGCTTACAGACAAGCTGTGACCGTCTCCGGGAGCTGCATGTGTCAGAGGTTTTCAC
CGTCATCACCGAAACGCGCGAGACGAAAGGGCCTCGTGATACGCCTATTTTTATAGGTTA
ATGTCATGATAATAATGGTTTCTTAGGACGGATCGCTTGCCTGTAACTTACACGCGCCTC
GTATCTTTTAATGATGGAATAATTTGGGAATTTACTCTGTGTTTATTTATTTTTATGTTT
TGTATTTGGATTTTAGAAAGTAAATAAAGAAGGTAGAAGAGTTACGGAATGAAGAAAAAA
AAATAAACAAAGGTTTAAAAAATTTCAACAAAAAGCGTACTTTACATATATATTTATTAG
ACAAGAAAAGCAGATTAAATAGATATACATTCGATTAACGATAAGTAAAATGTAAAATCA
CAGGATTTTCGTGTGTGGTCTTCTACACAGACAAGATGAAACAATTCGGCATTAATACCT
GAGAGCAGGAAGAGCAAGATAAAAGGTAGTATTTGTTGGCGATCCCCCTAGAGTCTTTTA
CATCTTCGGAAAACAAAAACTATTTTTTCTTTAATTTCTTTTTTTACTTTCTATTTTTAA
TTTATATATTTATATTAAAAAATTTAAATTATAATTATTTTTATAGCACGTGATGAAAAG
GACCCAGGTGGCACTTTTCGGGGAAATGTGCGCGGAACCCCTATTTGTTTATTTTTCTAA
ATACATTCAAATATGTATCCGCTCATGAGACAATAACCCTGATAAATGCTTCAATAATAT
TGAAAAAGGAAGAGTATGAGTATTCAACATTTCCGTGTCGCCCTTATTCCCTTTTTTGCG
GCATTTTGCCTTCCTGTTTTTGCTCACCCAGAAACGCTGGTGAAAGTAAAAGATGCTGAA
GATCAGTTGGGTGCACGAGTGGGTTACATCGAACTGGATCTCAACAGCGGTAAGATCCTT
GAGAGTTTTCGCCCCGAAGAACGTTTTCCAATGATGAGCACTTTTAAAGTTCTGCTATGT
GGCGCGGTATTATCCCGTATTGACGCCGGGCAAGAGCAACTCGGTCGCCGCATACACTAT
TCTCAGAATGACTTGGTTGAGTACTCACCAGTCACAGAAAAGCATCTTACGGATGGCATG
```

FIG.98B

ACAGTAAGAGAATTATGCAGTGCTGCCATAACCATGAGTGATAACACTGCGGCCAACTTA
CTTCTGACAACGATCGGAGGACCGAAGGAGCTAACCGCTTTTTTTCACAACATGGGGGAT
CATGTAACTCGCCTTGATCGTTGGGAACCGGAGCTGAATGAAGCCATACCAAACGACGAG
CGTGACACCACGATGCCTGTAGCAATGGCAACAACGTTGCGCAAACTATTAACTGGCGAA
CTACTTACTCTAGCTTCCCGGCAACAATTAATAGACTGGATGGAGGCGGATAAAGTTGCA
GGACCACTTCTGCGCTCGGCCCTTCCGGCTGGCTGGTTTATTGCTGATAAATCTGGAGCC
GGTGAGCGTGGGTCTCGCGGTATCATTGCAGCACTGGGGCCAGATGGTAAGCCCTCCCGT
ATCGTAGTTATCTACACGACGGGCAGTCAGGCAACTATGGATGAACGAAATAGACAGATC
GCTGAGATAGGTGCCTCACTGATTAAGCATTGGTAACTGTCAGACCAAGTTTACTCATAT
ATACTTTAGATTGATTTAAAACTTCATTTTTAATTTAAAAGGATCTAGGTGAAGATCCTT
TTTGATAATCTCATGACCAAAATCCCTTAACGTGAGTTTTCGTTCCACTGAGCGTCAGAC
CCCGTAGAAAAGATCAAAGGATCTTCTTGAGATCCTTTTTTTTCTGCGCGTAATCTGCTGC
TTGCAAACAAAAAAACCACCGCTACCAGCGGTGGTTTGTTTGCCGGATCAAGAGCTACCA
ACTCTTTTTCCGAAGGTAACTGGCTTCAGCAGAGCGCAGATACCAAATACTGTCCTTCTA
GTGTAGCCGTAGTTAGGCCACCACTTCAAGAACTCTGTAGCACCGCCTACATACCTCGCT
CTGCTAATCCTGTTACCAGTGGCTGCTGCCAGTGGCGATAAGTCGTGTCTTACCGGGTTG
GACTCAAGACGATAGTTACCGGATAAGGCGCAGCGGTCGGGCTGAACGGGGGGTTCGTGC
ACACAGCCCAGCTTGGAGCGAACGACCTACACCGAACTGAGATACCTACAGCGTGAGCAT
TGAGAAAGCGCCACGCTTCCCGAAGGGAGAAAGGCGGACAGGTATCCGGTAAGCGGCAGG
GTCGGAACAGGAGAGCGCACGAGGGAGCTTCCAGGGGGAACGCCTGGTATCTTTATAGT
CCTGTCGGGTTTCGCCACCTCTGACTTGAGCGTCGATTTTTGTGATGCTCGTCAGGGGGG
CCGAGCCTATGGAAAAACGCCAGCAACGCGGCCTTTTTACGGTTCCTGGCCTTTTGCTGG
CCTTTTGCTCACATGTTCTTTCCTGCGTTATCCCCTGATTCTGTGGATAACCGTATTACC
GCCTTTGAGTGAGCTGATACCGCTCGCCGCAGCCGAACGACCGAGCGCAGCGAGTCAGTG
AGCGAGGAAGCGGAAGAGCGCCCAATACGCAAACCGCCTCTCCCCGCGCGTTGGCCGATT
CATTAATGCAGCTGGCACGACAGGTTTCCCGACTGGAAAGCGGGCAGTGAGCGCAACGCA
ATTAATGTGAGTTACCTCACTCATTAGGCACCCCAGGCTTTACACTTTATGCTTCCGGCT
CCTATGTTGTGTGGAATTGTGAGCGGATAACAATTTCACACAGGAAACAGCTATGACCAT
GATTACGCCAAGCTCGGAATTAACCCTCACTAAAGGGAACAAAAGCTGGGTACCGGGCCC
CCCCTCGAGATCCGGGATCGAAGAAATGATGGTAAATGAAATAGGAAATCAAGGAGCATG
AAGGCAAAAGACAAATATAAGGGTCGAACGAAAAATAAAGTGAAAAGTGTTGATATGATG
TATTTGGCTTTGCGGCGCCGAAAAAACGAGTTTACGCAATTGCACAATCATGCTGACTCT
GTGGCGGACCCGCGCTCTTGCCGGCCCGGCGATAACGCTGGGCGTGAGGCTGTGCCCGGC
GGAGTTTTTTGCGCCTGCATTTTCCAAGGTTTACCCTGCGCTAAGGGGCGAGATTGGAGA
AGCAATAAGAATGCCGGTTGGGGTTGCGATGATGACGACCACGACAACTGGTGTCATTAT
TTAAGTTGCCGAAAGAACCTGAGTGCATTTGCAACATGAGTATACTAGAAGAATGAGCCA
AGACTTGCGAGACGCGAGTTTGCCGGTGGTGCGAACAATAGAGCGACCATGACCTTGAAG
GTGAGACGCGCATAACCGCTAGAGTACTTTGAAGAGGAAACAGCAATAGGGTTGCTACCA
GTATAAATAGACAGGTACATACAACACTGGAAATGGTTGTCTGTTTGAGTACGCTTTCAA
TTCATTTGGGTGTGCACTTTATTATGTTACAATATGGAAGGGAACTTTACACTTCTCCTA
TGCACATATATTAATTAAAGTCCAATGCTAGTAGAGAAGGGGGGTAACACCCCTCCGCGC

FIG.98C

```
TCTTTTCCGATTTTTTTTCTAAACCGTGGAATATTTCGGATATCCTTTTGTTGTTTCCGGG
TGTACAATATGGACTTCCTCTTTTCTGGCAACCAAACCCATACATCGGGATTCCTATAAT
ACCTTCGTTGGTCTCCCTAACATGTAGGTGGCGGAGGGGAGATATACAATAGAACAGATA
CCAGACAAGACATAATGGGCTAAACAAGACTACACCAATTACACTGCCTCATTGATGGTG
GTACATAACGAACTAATACTGTAGCCCTAGACTTGATAGCCATCATCATATCGAAGTTTC
ACTACCCTTTTTCCATTTGCCATCTATTGAAGTAATAATAGGCGCATGCAACTTCTTTTC
TTTTTTTTTCTTTTCTCTCTCCCCCGTTGTTGTCTCACCATATCCGCAATGACAAAAAAA
ATGATGGAAGACACTAAAGGAAAAAATTAACGACAAAGACAGCACCAACAGATGTCGTTG
TTCCAGAGCTGATGAGGGGTATCTTCGAACACACGAAACTTTTTCCTTCCTTCATTCACG
CACACTACTCTCTAATGAGCAACGGTATACGGCCTTCCTTCCAGTTACTTGAATTTGAAA
TAAAAAAAGTTTGCCGCTTTGCTATCAAGTATAAATAGACCTGCAATTATTAATCTTTTG
TTTCCTCGTCATTGTTCTCGTTCCCTTTCTTCCTTGTTTCTTTTTCTGCACAATATTTCA
AGCTATACCAAGCATACAATCAACTCCAAGCTTATGCCCAAGAAGAAGCGGAAGGTCTCG
AGCGGCGCCAATTTTAATCAAAGTGGGAATATTGCTGATAGCTCATTGTCCTTCACTTTC
ACTAACAGTAGCAACGGTCCGAACCTCATAACAACTCAAACAAATTCTCAAGCGCTTTCA
CAACCAATTGCCTCCTCTAACGTTCATGATAACTTCATGAATAATGAAATCACGGCTAGT
AAAATTGATGATGGTAATAATTCAAAACCACTGTCACCTGGTTGGACGGACCAAACTGCG
TATAACGCGTTTGGAATCACTACAGGGATGTTTAATACCACTACAATGGATGATGTATAT
AACTATCTATTCGATGATGAAGATACCCCACCAAACCCAAAAAAAGAGGGTGGGTCGATC
ACAAGTTTGTACAAAAAAGCAGGCTTGTCGACCCCGGGAATTCAGATCTACTAGTGCGGC
CGCACGCGTACCCAGCTTTCTTGTACAAAGTGGTGACGTCGAGCTCCCTATAGTGAGTCG
TATTACACTGGCCGTCGTTTTACAACGTCGTGACTGGGAAAACACCGGTGAGCTCTAAGT
AAGTAACGGCCGCCACCGCGGTGGAGCTTTGGACTTCTTCGCCAGAGGTTTGGTCAAGTC
TCCAATCAAGGTTGTCGGCTTGTCTACCTTGCCAGAAATTTACGAAAAGATGGAAAAGGG
TCAAATCGTTGGTAGATACGTTGTTGACACTTCTAAATAAGCGAATTTCTTATGATTTAT
GATTTTTATTATTAAATAAGTTATAAAAAAATAAGTGTATACAAATTTTAAAGTGACTC
TTAGGTTTTAAAACGAAAATTCTTGTTCTTGAGTAACTCTTTCCTGTAGGTCAGGTTGCT
TTCTCAGGTATAGCATGAGGTCGCTCTTATTGACCACACCTCTACCGGCATGCCGAGCAA
ATGCCTGCAAATCGCTCCCCATTTCACCCAATTGTAGATATGCTAACTCCAGCAATGAGT
TGATGAATCTCGGTGTGTATTTTATGTCCTCAGAGGACAATACCTGTTGTAATCGTTCTT
CCACACGGATCCGCATCAGGCGAAATTGTAAACGTTAATATTTTGTTAAAATTCGCGTTA
AATATTTGTTAAATCAGCTCATTTTTTAACCAATAGGCCGAAATCGGCAAAATCCCTTAT
AAATCAAAAGAATAGACCGAGATAGGGTTGAGTGTTGTTCCAGTTTGGAACAAGAGTCCA
CTATTAAAGAACGTGGACTCCAACGTCAAAGGGCGAAAAACCGTCTATCAGGGCGATGGC
CCACTACGTGAACCATCACCCTAATCAAGTTTTTTGGGGTCGAGGTGCCGTAAAGCACTA
AATCGGAACCCTAAAGGGAGCCCCCGATTTAGAGCTTGACGGGGAAAGCCGGCGAACGTG
GCGAGAAAGGAAGGGAAGAAAGCGAAAGGAGCGGGCGCTAGGGCGCTGGCAAGTGTAGCG
GTCACGCTGCGCGTAACCACCACACCCGCCGCGCTTAATGCGCCGCTACAGGGCGCGTCC
CATTCGCCATTCACTGCA
```

FIG.98D pMAB86 7146 bp

```
GACGAAAGGGCCTCGTGATACGCCTATTTTTATAGGTTAATGTCATGATAATAATGGTTT
CTTAGGACGGATCGCTTGCCTGTAACTTACACGCGCCTCGTATCTTTTAATGATGGAATA
ATTTGGGAATTTACTCTGTGTTTATTTATTTTTATGTTTTGTATTTGGATTTTAGAAAGT
AAATAAAGAAGGTAGAAGAGTTACGGAATGAAGAAAAAAAAATAAACAAAGGTTTAAAAA
ATTTCAACAAAAAGCGTACTTTACATATATATTTATTAGACAAGAAAAGCAGATTAAATA
GATATACATTCGATTAACGATAAGTAAAATGTAAAATCACAGGATTTTCGTGTGTGGTCT
TCTACACAGACAAGATGAAACAATTCGGCATTAATACCTGAGAGCAGGAAGAGCAAGATA
AAAGGTAGTATTTGTTGGCGATCCCCCTAGAGTCTTTTACATCTTCGGAAAACAAAAACT
ATTTTTTCTTTAATTTCTTTTTTTACTTTCTATTTTTAATTTATATATTTATATTAAAAA
ATTTAAATTATAATTATTTTTATAGCACGTGATGAAAAGGACCCAGGTGGCACTTTTCGG
GGAAATGTGCGCGGAACCCCTATTTGTTTATTTTTCTAAATACATTCAAATATGTATCCG
CTCATGAGACAATAACCCTGATAAATGCTTCAATAATATTGAAAAAGGAAGAGTATGAGT
ATTCAACATTTCCGTGTCGCCCTTATTCCCTTTTTTGCGGCATTTTGCCTTCCTGTTTTT
GCTCACCCAGAAACGCTGGTGAAAGTAAAAGATGCTGAAGATCAGTTGGGTGCACGAGTG
GGTTACATCGAACTGGATCTCAACAGCGGTAAGATCCTTGAGAGTTTTCGCCCCGAAGAA
CGTTTTCCAATGATGAGCACTTTTAAAGTTCTGCTATGTGGCGCGGTATTATCCCGTATT
GACGCCGGGCAAGAGCAACTCGGTCGCCGCATACACTATTCTCAGAATGACTTGGTTGAG
TACTCACCAGTCACAGAAAAGCATCTTACGGATGGCATGACAGTAAGAGAATTATGCAGT
GCTGCCATAACCATGAGTGATAACACTGCGGCCAACTTACTTCTGACAACGATCGGAGGA
CCGAAGGAGCTAACCGCTTTTTTTCACAACATGGGGGATCATGTAACTCGCCTTGATCGT
TGGGAACCGGAGCTGAATGAAGCCATACCAAACGACGAGCGTGACACCACGATGCCTGTA
GCAATGGCAACAACGTTGCGCAAACTATTAACTGGCGAACTACTTACTCTAGCTTCCCGG
CAACAATTAATAGACTGGATGGAGGCGGATAAAGTTGCAGGACCACTTCTGCGCTCGGCC
CTTCCGGCTGGCTGGTTTATTGCTGATAAATCTGGAGCCGGTGAGCGTGGGTCTCGCGGT
ATCATTGCAGCACTGGGGCCAGATGGTAAGCCCTCCCGTATCGTAGTTATCTACACGACG
GGCAGTCAGGCAACTATGGATGAACGAAATAGACAGATCGCTGAGATAGGTGCCTCACTG
ATTAAGCATTGGTAACTGTCAGACCAAGTTTACTCATATATACTTTAGATTGATTTAAAA
CTTCATTTTTAATTTAAAAGGATCTAGGTGAAGATCCTTTTTGATAATCTCATGACCAAA
ATCCCTTAACGTGAGTTTTCGTTCCACTGAGCGTCAGACCCCGTAGAAAAGATCAAAGGA
TCTTCTTGAGATCCTTTTTTTCTGCGCGTAATCTGCTGCTTGCAAACAAAAAAACCACCG
CTACCAGCGGTGGTTTGTTTGCCGGATCAAGAGCTACCAACTCTTTTTCCGAAGGTAACT
GGCTTCAGCAGAGCGCAGATACCAAATACTGTCCTTCTAGTGTAGCCGTAGTTAGGCCAC
CACTTCAAGAACTCTGTAGCACCGCCTACATACCTCGCTCTGCTAATCCTGTTACCAGTG
GCTGCTGCCAGTGGCGATAAGTCGTGTCTTACCGGGTTGGACTCAAGACGATAGTTACCG
GATAAGGCGCAGCGGTCGGGCTGAACGGGGGGTTCGTGCACACAGCCCAGCTTGGAGCGA
ACGACCTACACCGAACTGAGATACCTACAGCGTGAGCATTGAGAAAGCGCCACGCTTCCC
GAAGGGAGAAAGGCGGACAGGTATCCGGTAAGCGGCAGGGTCGGAACAGGAGAGCGCACG
AGGGAGCTTCCAGGGGGGAACGCCTGGTATCTTTATAGTCCTGTCGGGTTTCGCCACCTC
```

FIG.99B

```
TGACTTGAGCGTCGATTTTTTGTGATGCTCGTCAGGGGGGCCGAGCCTATGGAAAAACGCC
AGCAACGCGGCCTTTTTACGGTTCCTGGCCTTTTGCTGGCCTTTTGCTCACATGTTCTTT
CCTGCGTTATCCCCTGATTCTGTGGATAACCGTATTACCGCCTTTGAGTGAGCTGATACC
GCTCGCCGCAGCCGAACGACCGAGCGCAGCGAGTCAGTGAGCGAGGAAGCGGAAGAGCGC
CCAATACGCAAACCGCCTCTCCCCGCGCGTTGGCCGATTCATTAATGCAGCTGGCACGAC
AGGTTTCCCGACTGGAAAGCGGGCAGTGAGCGCAACGCAATTAATGTGAGTTACCTCACT
CATTAGGCACCCCAGGCTTTACACTTTATGCTTCCGGCTCCTATGTTGTGTGGAATTGTG
AGCGGATAACAATTTCACACAGGAAACAGCTATGACCATGATTACGCCAAGCTCGGAATT
AACCCTCACTAAAGGGAACAAAAGCTGGGTACCGGGCCCCCCCTCGAGATCCGGGATCGA
AGAAATGATGGTAAATGAAATAGGAAATCAAGGAGCATGAAGGCAAAAGACAAATATAAG
GGTCGAACGAAAAATAAAGTGAAAAGTGTTGATATGATGTATTTGGCTTTGCGGCGCCGA
AAAAACGAGTTTACGCAATTGCACAATCATGCTGACTCTGTGGCGGACCCGCGCTCTTGC
CGGCCCGGCGATAACGCTGGGCGTGAGGCTGTGCCCGGCGGAGTTTTTTGCGCCTGCATT
TTCCAAGGTTTACCCTGCGCTAAGGGGCGAGATTGGAGAAGCAATAAGAATGCCGGTTGG
GGTTGCGATGATGACGACCACGACAACTGGTGTCATTATTTAAGTTGCCGAAAGAACCTG
AGTGCATTTGCAACATGAGTATACTAGAAGAATGAGCCAAGACTTGCGAGACGCGAGTTT
GCCGGTGGTGCGAACAATAGAGCGACCATGACCTTGAAGGTGAGACGCGCATAACCGCTA
GAGTACTTTGAAGAGGAAACAGCAATAGGGTTGCTACCAGTATAAATAGACAGGTACATA
CAACACTGGAAATGGTTGTCTGTTTGAGTACGCTTTCAATTCATTTGGGTGTGCACTTTA
TTATGTTACAATATGGAAGGGAACTTTACACTTCTCCTATGCACATATATTAATTAAAGT
CCAATGCTAGTAGAGAAGGGGGGTAACACCCCTCCGCGCTCTTTTCCGATTTTTTTCTAA
ACCGTGGAATATTTCGGATATCCTTTTGTTGTTTCCGGGTGTACAATATGGACTTCCTCT
TTTCTGGCAACCAAACCCATACATCGGGATTCCTATAATACCTTCGTTGGTCTCCCTAAC
ATGTAGGTGGCGGAGGGGAGATATACAATAGAACAGATACCAGACAAGACATAATGGGCT
AAACAAGACTACACCAATTACACTGCCTCATTGATGGTGGTACATAACGAACTAATACTG
TAGCCCTAGACTTGATAGCCATCATCATATCGAAGTTTCACTACCCTTTTTCCATTTGCC
ATCTATTGAAGTAATAATAGGCGCATGCAACTTCTTTTCTTTTTTTTCTTTTCTCTCTC
CCCCGTTGTTGTCTCACCATATCCGCAATGACAAAAAAAATGATGGAAGACACTAAAGGA
AAAAATTAACGACAAAGACAGCACCAACAGATGTCGTTGTTCCAGAGCTGATGAGGGGTA
TCTTCGAACACACGAAACTTTTTCCTTCCTTCATTCACGCACACTACTCTCTAATGAGCA
ACGGTATACGGCCTTCCTTCCAGTTACTTGAATTTGAAATAAAAAAAGTTTGCCGCTTTG
CTATCAAGTATAAATAGACCTGCAATTATTAATCTTTTGTTTCCTCGTCATTGTTCTCGT
TCCCTTTCTTCCTTGTTTCTTTTTCTGCACAATATTTCAAGCTATACCAAGCATACAATC
AACTCCAAGCTTATGCCCAAGAAGAAGCGGAAGGTCTCGAGCGGCGCCAATTTTAATCAA
AGTGGGAATATTGCTGATAGCTCATTGTCCTTCACTTTCACTAACAGTAGCAACGGTCCG
AACCTCATAACAACTCAAACAAATTCTCAAGCGCTTTCACAACCAATTGCCTCCTCTAAC
GTTCATGATAACTTCATGAATAATGAAATCACGGCTAGTAAAATTGATGATGGTAATAAT
TCAAAACCACTGTCACCTGGTTGGACGGACCAAACTGCGTATAACGCGTTTGGAATCACT
ACAGGGATGTTTAATACCACTACAATGGATGATGTATATAACTATCTATTCGATGATGAA
GATACCCCACCAAACCCAAAAAAAGAGGGTGGGTCGATCACAAGTTTGTACAAAAAAGCA
GGCTTGTCGACCCCGGGAATTCAGATCTACTAGTGCGGCCGCACGCGTACCCAGCTTTCT
```

FIG.99C

```
TGTACAAAGTGGTGACGTCGAGCTCTAAGTAAGTAACGGCCGCCACCGCGGTGGAGCTTT
GGACTTCTTCGCCAGAGGTTTGGTCAAGTCTCCAATCAAGGTTGTCGGCTTGTCTACCTT
GCCAGAAATTTACGAAAAGATGGAAAAGGGTCAAATCGTTGGTAGATACGTTGTTGACAC
TTCTAAATAAGCGAATTTCTTATGATTTATGATTTTTATTATTAAATAAGTTATAAAAAA
AATAAGTGTATACAAATTTTAAAGTGACTCTTAGGTTTTAAAACGAAAATTCTTGTTCTT
GAGTAACTCTTTCCTGTAGGTCAGGTTGCTTTCTCAGGTATAGCATGAGGTCGCTCTTAT
TGACCACACCTCTACCGGCATGCCGAGCAAATGCCTGCAAATCGCTCCCCATTTCACCCA
ATTGTAGATATGCTAACTCCAGCAATGAGTTGATGAATCTCGGTGTGTATTTTATGTCCT
CAGAGGACAATACCTGTTGTAATCGTTCTTCCACACGGATCCCAATTCGCCCTATAGTGA
GTCGTATTACAATTCACTGGCCGTCGTTTTACAACGTCGTGACTGGGAAAACCCTGGCGT
TACCCAACTTAATCGCCTTGCAGCACATCCCCCTTTCGCCAGCTGGCGTAATAGCGAAGA
GGCCCGCACCGATCGCCCTTCCCAACAGTTGCGCAGCCTGAATGGCGAATGGACGCGCCC
TGTAGCGGCGCATTAAGCGCGGCGGGTGTGGTGGTTACGCGCAGCGTGACCGCTACACTT
GCCAGCGCCCTAGCGCCCGCTCCTTTCGCTTTCTTCCCTTCCTTTCTCGCCACGTTCGCC
GGCTTTCCCCGTCAAGCTCTAAATCGGGGGCTCCCTTTAGGGTTCCGATTTAGTGCTTTA
CGGCACCTCGACCCCAAAAAACTTGATTAGGGTGATGGTTCACGTAGTGGGCCATCGCCC
TGATAGACGGTTTTTCGCCCTTTGACGTTGGAGTCCACGTTCTTTAATAGTGGACTCTTG
TTCCAAACTGGAACAACACTCAACCCTATCTCGGTCTATTCTTTTGATTTATAAGGGATT
TTGCCGATTTCGGCCTATTGGTTAAAAAATGAGCTGATTTAACAAAAATTTAACGCGAAT
TTTAACAAAATATTAACGTTTACAATTTCCTGATGCGGTATTTTCTCCTTACGCATCTGT
GCGGTATTTCACACCGCAGGCAAGTGCACAAACAATACTTAAATAAATACTACTCAGTAA
TAACCTATTTCTTAGCATTTTTGACGAAATTTGCTATTTTGTTAGAGTCTTTTACACCAT
TTGTCTCCACACCTCCGCTTACATCAACACCAATAACGCCATTTAATCTAAGCGCATCAC
CAACATTTTCTGGCGTCAGTCCACCAGCTAACATAAAATGTAAGCTTTCGGGGCTCTCTT
GCCTTCCAACCCAGTCAGAAATCGAGTTCCAATCCAAAAGTTCACCTGTCCCACCTGCTT
CTGAATCAAACAAGGGAATAAACGAATGAGGTTTCTGTGAAGCTGCACTGAGTAGTATGT
TGCAGTCTTTTGGAAATACGAGTCTTTTAATAACTGGCAAACCGAGGAACTCTTGGTATT
CTTGCCACGACTCATCTCCATGCAGTTGGACGATATCAATGCCGTAATCATTGACCAGAG
CCAAAACATCCTCCTTAGGTTGATTACGAAACACGCCAACCAAGTATTTCGGAGTGCCTG
AACTATTTTTATATGCTTTTACAAGACTTGAAATTTTCCTTGCAATAACCGGGTCAATTG
TTCTCTTTCTATTGGGCACACATATAATACCCAGCAAGTCAGCATCGGAATCTAGAGCAC
ATTCTGCGGCCTCTGTGCTCTGCAAGCCGCAAACTTTCACCAATGGACCAGAACTACCTG
TGAAATTAATAACAGACATACTCCAAGCTGCCTTTGTGTGCTTAATCACGTATACTCACG
TGCTCAATAGTCACCAATGCCCTCCCTCTTGGCCCTCTCCTTTTCTTTTTTCGACCGAAT
TAATTCTTAATCGGCAAAAAAGAAAAGCTCCGGATCAAGATTGTACGTAAGGTGACAAG
CTATTTTTCAATAAAGAATATCTTCCACTACTGCCATCTGGCGTCATAACTGCAAAGTAC
ACATATATTACGATGCTGTCTATTAAATGCTTCCTATATTATATATATAGTAATGTCGTT
TATGGTGCACTCTCAGTACAATCTGCTCTGATGCCGCATAGTTAAGCCAGCCCCGACACC
CGCCAACACCCGCTGACGCGCCCTGACGGGCTTGTCTGCTCCCGGCATCCGCTTACAGAC
AAGCTGTGACCGTCTCCGGGAGCTGCATGTGTCAGAGGTTTTCACCGTCATCACCGAAAC
GCGCGA
```

FIG.99D

COMPOSITIONS FOR USE IN RECOMBINATIONAL CLONING OF NUCELIC ACIDS

CROSS REFERENCE TO RELATED APPLICATIONS

The present application is a continuation of U.S. patent application Ser. No. 09/517,466, filed Mar. 2, 2000, now U.S. Pat. No. 7,670,823, which claims the benefit of the filing dates of U.S. Provisional Application Nos. 60/136,784, filed May 28, 1999; 60/126,049 filed Mar. 23, 1999; and 60/122,389, filed Mar. 2, 1999 all of which are incorporated herein by reference in their entireties.

SEQUENCE LISTING

The instant application contains a Sequence Listing which has been submitted in ASCII format via EFS-Web and is hereby incorporated by reference in its entirety. Said ASCII copy, created on Oct. 13, 2010, is named IVGN2231.txt and is 564,004 bytes in size.

BACKGROUND OF THE INVENTION

1. Field of the Invention

The present invention relates generally to recombinant DNA technology. More particularly, the present invention relates to compositions and methods for use in recombinational cloning of nucleic acid molecules. The invention relates specifically to nucleic acid molecules encoding one or more recombination sites or one or more partial recombination sites, particularly attB, attP, attL, and attR, and fragments, mutants, variants and derivatives thereof. The invention also relates to such nucleic acid molecules wherein the one or more recombination site nucleotide sequences is operably linked to the one or more additional physical or functional nucleotide sequences. The invention also relates to vectors comprising the nucleic acid molecules of the invention, to host cells comprising the vectors or nucleic acid molecules of the invention, to methods of producing polypeptides and RNAs encoded by the nucleic acid molecules of the invention, and to polypeptides encoded by these nucleic acid molecules or produced by the methods of the invention, which may be fusion proteins. The invention also relates to antibodies that bind to one or more polypeptides of the invention or epitopes thereof, which may be monoclonal or polyclonal antibodies. The invention also relates to the use of these nucleic acid molecules, vectors, polypeptides and antibodies in methods for recombinational cloning of nucleic acids, in vitro and in vivo, to provide chimeric DNA molecules that have particular characteristics and/or DNA segments. More particularly, the antibodies of the invention may be used to identify and/or purify proteins or fusion proteins encoded by the nucleic acid molecules or vectors of the invention, or to identify and/or purify the nucleic acid molecules of the invention.

2. Related Art

Site-specific recombinases. Site-specific recombinases are proteins that are present in many organisms (e.g. viruses and bacteria) and have been characterized to have both endonuclease and ligase properties. These recombinases (along with associated proteins in some cases) recognize specific sequences of bases in DNA and exchange the DNA segments flanking those segments. The recombinases and associated proteins are collectively referred to as "recombination proteins" (see, e.g., Landy, A., *Current Opinion in Biotechnology* 3:699-707 (1993)).

Numerous recombination systems from various organisms have been described. See, e.g., Hoess et al., *Nucleic Acids Research* 14(6):2287 (1986); Abremski et al., *J. Biol. Chem.* 261(1):391 (1986); Campbell, *J. Bacteriol.* 174(23):7495 (1992); Qian et al., *J. Biol. Chem.* 267(11):7794 (1992); Araki et al., *J. Mol. Biol.* 225(1):25 (1992); Maeser and Kahnmann *Mol. Gen. Genet.* 230:170-176) (1991); Esposito et al., *Nucl. Acids Res.* 25(18):3605 (1997).

Many of these belong to the integrase family of recombinases (Argos et al. *EMBO J.* 5:433-440 (1986); Voziyanov et al., *Nucl. Acids Res.* 27:930 (1999)). Perhaps the best studied of these are the Integrase/att system from bacteriophage λ (Landy, A. *Current Opinions in Genetics and Devel.* 3:699-707 (1993)), the Cre/loxP system from bacteriophage P1 (Hoess and Abremski (1990) In *Nucleic Acids and Molecular Biology*, vol. 4. Eds.: Eckstein and Lilley, Berlin-Heidelberg: Springer-Verlag; pp. 90-109), and the FLP/FRT system from the *Saccharomyces cerevisiae* 2μ circle plasmid (Broach et al. *Cell* 29:227-234 (1982)).

Backman (U.S. Pat. No. 4,673,640) discloses the in vivo use of λ recombinase to recombine a protein producing DNA segment by enzymatic site-specific recombination using wild-type recombination sites attB and attP.

Hasan and Szybalski (*Gene* 56:145-151 (1987)) discloses the use of λ Int recombinase in vivo for intramolecular recombination between wild type attP and attB sites which flank a promoter. Because the orientations of these sites are inverted relative to each other, this causes an irreversible flipping of the promoter region relative to the gene of interest.

Palazzolo et al. *Gene* 88:25-36 (1990), discloses phage lambda vectors having bacteriophage λ arms that contain restriction sites positioned outside a cloned DNA sequence and between wild-type loxP sites. Infection of *E. coli* cells that express the Cre recombinase with these phage vectors results in recombination between the loxP sites and the in vivo excision of the plasmid replicon, including the cloned cDNA.

Pósfai et al. (*Nucl. Acids Res.* 22:2392-2398 (1994)) discloses a method for inserting into genomic DNA partial expression vectors having a selectable marker, flanked by two wild-type FRT recognition sequences. FLP site-specific recombinase as present in the cells is used to integrate the vectors into the genome at predetermined sites. Under conditions where the replicon is functional, this cloned genomic DNA can be amplified.

Bebee et al. (U.S. Pat. No. 5,434,066) discloses the use of site-specific recombinases such as Cre for DNA containing two loxP sites for in vivo recombination between the sites.

Boyd (*Nucl. Acids Res.* 21:817-821 (1993)) discloses a method to facilitate the cloning of blunt-ended DNA using conditions that encourage intermolecular ligation to a dephosphorylated vector that contains a wild-type loxP site acted upon by a Cre site-specific recombinase present in *E. coli* host cells.

Waterhouse et al. (WO 93/19172 and *Nucleic Acids Res.* 21 (9):2265 (1993)) disclose an in vivo method where light and heavy chains of a particular antibody were cloned in different phage vectors between loxP and loxP 511 sites and used to transfect new *E. coli* cells. Cre, acting in the host cells on the two parental molecules (one plasmid, one phage), produced four products in equilibrium: two different cointegrates (produced by recombination at either loxP or loxP 511 sites), and two daughter molecules, one of which was the desired product.

Schlake & Bode (*Biochemistry* 33:12746-12751 (1994)) discloses an in vivo method to exchange expression cassettes at defined chromosomal locations, each flanked by a wild type and a spacer-mutated FRT recombination site. A double-reciprocal crossover was mediated in cultured mammalian cells by using this FLP/FRT system for site-specific recombination.

Hartley et al. (U.S. Pat. No. 5,888,732) disclose compositions and methods for recombinational exchange of nucleic acid segments and molecules, including for use in recombinational cloning of a variety of nucleic acid molecules in vitro and in vivo, using a combination of wildtype and mutated recombination sites and recombination proteins.

Transposases. The family of enzymes, the transposases, has also been used to transfer genetic information between replicons. Transposons are structurally variable, being described as simple or compound, but typically encode the recombinase gene flanked by DNA sequences organized in inverted orientations. Integration of transposons can be random or highly specific. Representatives such as Tn7, which are highly site-specific, have been applied to the in vivo movement of DNA segments between replicons (Lucklow et al., *J. Virol.* 67:4566-4579 (1993)).

Devine and Boeke *Nucl. Acids Res.* 22:3765-3772 (1994), discloses the construction of artificial transposons for the insertion of DNA segments, in vitro, into recipient DNA molecules. The system makes use of the integrase of yeast TY1 virus-like particles. The DNA segment of interest is cloned, using standard methods, between the ends of the transposon-like element TY1. In the presence of the TY1 integrase, the resulting element integrates randomly into a second target DNA molecule.

Recombination Sites. Also key to the integration/recombination reactions mediated by the above-noted recombination proteins and/or transposases are recognition sequences, often termed "recombination sites," on the DNA molecules participating in the integration/recombination reactions. These recombination sites are discrete sections or segments of DNA on the participating nucleic acid molecules that are recognized and bound by the recombination proteins during the initial stages of integration or recombination. For example, the recombination site for Cre recombinase is loxP which is a 34 base pair sequence comprised of two 13 base pair inverted repeats (serving as the recombinase binding sites) flanking an 8 base pair core sequence. See FIG. 1 of Sauer, B., *Curr. Opin. Biotech.* 5:521-527 (1994). Other examples of recognition sequences include the attB, attP, attL, and attR sequences which are recognized by the recombination protein λ Int. attB is an approximately 25 base pair sequence containing two 9 base pair core-type Int binding sites and a 7 base pair overlap region, while attP is an approximately 240 base pair sequence containing core-type Int binding sites and arm-type Int binding sites as well as sites for auxiliary proteins integration host factor (IHF), FIS and excisionase (Xis). See Landy, *Curr. Opin. Biotech.* 3:699-707 (1993); see also U.S. Pat. No. 5,888,732, which is incorporated by reference herein.

DNA cloning. The cloning of DNA segments currently occurs as a daily routine in many research labs and as a prerequisite step in many genetic analyses. The purpose of these clonings is various, however, two general purposes can be considered: (1) the initial cloning of DNA from large DNA or RNA segments (chromosomes, YACs, PCR fragments, mRNA, etc.), done in a relative handful of known vectors such as pUC, pGem, pBlueScript, and (2) the subcloning of these DNA segments into specialized vectors for functional analysis. A great deal of time and effort is expended both in the transfer of DNA segments from the initial cloning vectors to the more specialized vectors. This transfer is called subcloning.

The basic methods for cloning have been known for many years and have changed little during that time. A typical cloning protocol is as follows:
(1) digest the DNA of interest with one or two restriction enzymes;
(2) gel purify the DNA segment of interest when known;
(3) prepare the vector by cutting with appropriate restriction enzymes, treating with alkaline phosphatase, gel purify etc., as appropriate;
(4) ligate the DNA segment to the vector, with appropriate controls to eliminate background of uncut and self-ligated vector;
(5) introduce the resulting vector into an *E. coli* host cell;
(6) pick selected colonies and grow small cultures overnight;
(7) make DNA minipreps; and
(8) analyze the isolated plasmid on agarose gels (often after diagnostic restriction enzyme digestions) or by PCR.

The specialized vectors used for subcloning DNA segments are functionally diverse. These include but are not limited to: vectors for expressing nucleic acid molecules in various organisms; for regulating nucleic acid molecule expression; for providing tags to aid in protein purification or to allow tracking of proteins in cells, for modifying the cloned DNA segment (e.g., generating deletions); for the synthesis of probes (e.g., riboprobes); for the preparation of templates for DNA sequencing; for the identification of protein coding regions; for the fusion of various protein-coding regions; to provide large amounts of the DNA of interest, etc. It is common that a particular investigation will involve subcloning the DNA segment of interest into several different specialized vectors.

As known in the art, simple subclonings can be done in one day (e.g., the DNA segment is not large and the restriction sites are compatible with those of the subcloning vector). However, many other subclonings can take several weeks, especially those involving unknown sequences, long fragments, toxic genes, unsuitable placement of restriction sites, high backgrounds, impure enzymes, etc. Subcloning DNA fragments is thus often viewed as a chore to be done as few times as possible.

Several methods for facilitating the cloning of DNA segments have been described, e.g., as in the following references.

Ferguson, J., et al. *Gene* 16:191 (1981), discloses a family of vectors for subcloning fragments of yeast DNA. The vectors encode kanamycin resistance. Clones of longer yeast DNA segments can be partially digested and ligated into the subcloning vectors. If the original cloning vector conveys resistance to ampicillin, no purification is necessary prior to transformation, since the selection will be for kanamycin.

Hashimoto-Gotoh, T., et al. *Gene* 41:125 (1986), discloses a subcloning vector with unique cloning sites within a streptomycin sensitivity gene; in a streptomycin-resistant host, only plasmids with inserts or deletions in the dominant sensitivity gene will survive streptomycin selection.

Accordingly, traditional subcloning methods, using restriction enzymes and ligase, are time consuming and relatively unreliable. Considerable labor is expended, and if two or more days later the desired subclone can not be found among the candidate plasmids, the entire process must then be repeated with alternative conditions attempted. Although site specific recombinases have been used to recombine DNA in vivo, the successful use of such enzymes in vitro was expected to suffer from several problems. For example, the site specificities and efficiencies were expected to differ in vitro; topologically linked products were expected; and the topology of the DNA substrates and recombination proteins was expected to differ significantly in vitro (see, e.g., Adams et al, *J. Mol. Biol.* 226:661-73 (1992)). Reactions that could go on for many hours in vivo were expected to occur in significantly less time in vitro before the enzymes became inactive. In addition, the stabilities of the recombination enzymes after incubation for extended periods of time in in vitro reactions was unknown, as were the effects of the topologies (i.e., linear, coiled, supercoiled, etc.) of the nucleic acid molecules involved in the reaction. Multiple DNA recombination products were expected in the biological host used, resulting in unsatisfactory reliability, specificity or efficiency of subcloning. Thus, in vitro recombination reactions were not expected to be sufficiently efficient to yield the desired levels of product.

Accordingly, there is a long felt need to provide an alternative subcloning system that provides advantages over the known use of restriction enzymes and ligases.

SUMMARY OF THE INVENTION

The present invention relates to nucleic acid molecules encoding one or more recombination sites or one or more partial recombination sites, particularly attB, attP, attL, and attR, and fragments, mutants, variants and derivatives thereof. The invention also relates to such nucleic acid molecules comprising one or more of the recombination site nucleotide sequences or portions thereof and one or more additional physical or functional nucleotide sequences, such as those encoding one or more multiple cloning sites, one or more transcription termination sites, one or more transcriptional regulatory sequences (e.g., one or more promoters, enhancers, or repressors), one or more translational signal sequences, one or more nucleotide sequences encoding a fusion partner protein or peptide (e.g., GST, $His_6$ or thioredoxin), one or more selection markers or modules, one or more nucleotide sequences encoding localization signals such as nuclear localization signals or secretion signals, one or more origins of replication, one or more protease cleavage sites, one or more desired proteins or peptides encoded by a gene or a portion of a gene, and one or more 5' or 3' polynucleotide tails (particularly a poly-G tail). The invention also relates to such nucleic acid molecules wherein the one or more recombination site nucleotide sequences is operably linked to the one or more additional physical or functional nucleotide sequences.

The invention also relates to primer nucleic acid molecules comprising the recombination site nucleotide sequences of the invention (or portions thereof), and to such primer nucleic acid molecules linked to one or more target-specific (e.g., one or more gene-specific) primer-nucleic acid sequences. Such primers may also comprise sequences complementary or homologous to DNA or RNA sequences to be amplified, e.g., by PCR, RT-PCR, etc. Such primers may also comprise sequences or portions of sequences useful in the expression of protein genes (ribosome binding sites, localization signals, protease cleavage sites, repressor binding sites, promoters, transcription stops, stop codons, etc.). Said primers may also comprise sequences or portions of sequences useful in the manipulation of DNA molecules (restriction sites, transposition sites, sequencing primers, etc.). The primers of the invention may be used in nucleic acid synthesis and preferably are used for amplification (e.g., PCR) of nucleic acid molecules. When the primers of the invention include target- or gene- specific sequences (any sequence contained within the target to be synthesized or amplified including translation signals, gene sequences, stop codons, transcriptional signals (e.g., promoters) and the like), amplification or synthesis of target sequences or genes may be accomplished. Thus, the invention relates to synthesis of a nucleic acid molecules comprising mixing one or more primers of the invention with a nucleic acid template, and incubating said mixture under conditions sufficient to make a first nucleic acid molecule complementary to all or a portion of said template. Thus, the invention relates specifically to a method of synthesizing a nucleic acid molecule comprising:

(a) mixing a nucleic acid template with a polypeptide having polymerase activity and one or more primers comprising one or more recombination sites or portions thereof; and (b) incubating said mixture under conditions sufficient to synthesize a first nucleic acid molecule complementary to all or a portion of said template and which preferably comprises one or more recombination sites or portions thereof.

Such method of the invention may further comprise incubating said first synthesized nucleic acid molecule under conditions sufficient to synthesize a second nucleic acid molecule complementary to all or a portion of said first nucleic acid molecule. Such synthesis may provide for a first nucleic acid molecule having a recombination site or portion thereof at one or both of its termini.

In a preferred aspect, for the synthesis of the nucleic acid molecules, at least two primers are used wherein each primer comprises a homologous sequence at its terminus and/or within internal sequences of each primer (which may have a homology length of about 2 to about 500 bases, preferably about 3 to about 100 bases, about 4 to about 50 bases, about 5 to about 25 bases and most preferably about 6 to about 18 base overlap). In a preferred aspect, the first such primer comprises at least one target-specific sequence and at least one recombination site or portion thereof while the second primer comprises at least one recombination site or portion thereof. Preferably, the homologous regions between the first and second primers comprise at least a portion of the recombination site. In another aspect, the homologous regions between the first and second primers may comprise one or more additional sequences, e.g., expression signals, translational start motifs, or other sequences adding functionality to the desired nucleic acid sequence upon amplification. In practice, two pairs of primers prime synthesis or amplification of a nucleic acid molecule. In a preferred aspect, all or at least a portion of the synthesized or amplified nucleic acid molecule will be homologous to all or a portion of the template and further comprises a recombination site or a portion thereof at least one terminus and preferably both termini of the synthesized or amplified molecule. Such synthesized or amplified nucleic acid molecule may be double stranded or single stranded and may be used in the recombinational cloning methods of the invention. The homologous primers of the invention provide a substantial advantage in that one set of the primers may be standardized for any synthesis or amplification reaction. That is, the primers providing the recombination site sequences (without the target specific sequences) can be pre-made and readily available for use. This in practice allows the use of shorter custom made primers that contain the target specific sequence needed to synthesize or amplify the desired nucleic acid molecule. Thus, this provides reduced time and cost in preparing target specific primers (e.g., shorter primers containing the target specific sequences can be prepared and used in synthesis reactions). The standardized primers, on the other hand, may be produced in mass to reduce cost and can be readily provided (e.g., in kits or as a product) to facilitate synthesis of the desired nucleic acid molecules.

Thus, in one preferred aspect, the invention relates to a method of synthesizing or amplifying one or more nucleic acid molecules comprising:
(a) mixing one or more nucleic acid templates with at least one polypeptide having polymerase or reverse transcriptase activity and at least a first primer comprising a template specific sequence (complementary to or capable of hybridizing to said templates) and at least a second primer comprising all or a portion of a recombination site wherein said at least a portion of said second primer is homologous to or complementary to at least a portion of said first primer; and
(b) incubating said mixture under conditions sufficient to synthesize or amplify one or more nucleic acid molecules complementary to all or a portion of said templates and comprising one or more recombination sites or portions thereof at one and preferably both termini of said molecules.

More specifically, the invention relates to a method of synthesizing or amplifying one or more nucleic acid molecules comprising:
(a) mixing one or more nucleic acid templates with at least one polypeptide having polymerase or reverse transcriptase activity and at least a first primer comprising a template specific sequence (complementary to or capable of hybridizing to said templates) and at least a portion of a recombination site, and at least a second primer comprising all or a portion of a recombination site wherein said at least a portion of said recombination site on said second primer is complementary to or homologous to at least a portion of said recombination site on said first primer; and
(b) incubating said mixture under conditions sufficient to synthesize or amplify one or more nucleic acid molecules complementary to all or a portion of said templates and comprising one or more recombination sites or portions thereof at one and preferably both termini of said molecules.

In a more preferred aspect, the invention relates to a method of amplifying or synthesizing one or more nucleic acid molecules comprising:
(a) mixing one or more nucleic acid templates with at least one polypeptide having polymerase or reverse transcriptase activity and one or more first primers comprising at least a portion of a recombination site and a template specific sequence (complementary to or capable of hybridizing to said template);
(b) incubating said mixture under conditions sufficient to synthesize or amplify one or more first nucleic acid molecules complementary to all or a portion of said templates wherein said molecules comprise at least a portion of a recombination site at one and preferably both termini of said molecules;
(c) mixing said molecules with one or more second primers comprising one or more recombination sites, wherein said recombination sites of said second primers are homologous to or complementary to at least a portion of said recombination sites on said first nucleic acid molecules; and
(d) incubating said mixture under conditions sufficient to synthesize or amplify one or more second nucleic acid molecules complementary to all or a portion of said first nucleic acid molecules and which comprise one or more recombination sites at one and preferably both termini of said molecules.

The invention also relates to vectors comprising the nucleic acid molecules of the invention, to host cells comprising the vectors or nucleic acid molecules of the invention, to methods of producing polypeptides encoded by the nucleic acid molecules of the invention, and to polypeptides encoded by these nucleic acid molecules or produced by the methods of the invention, which may be fusion proteins. The invention also relates to antibodies that bind to one or more polypeptides of the invention or epitopes thereof, which may be monoclonal or polyclonal antibodies. The invention also relates to the use of these nucleic acid molecules, primers, vectors, polypeptides and antibodies in methods for recombinational cloning of nucleic acids, in vitro and in vivo, to provide chimeric DNA molecules that have particular characteristics and/or DNA segments.

The antibodies of the invention may have particular use to identify and/or purify peptides or proteins (including fusion proteins produced by the invention), and to identify and/or purify the nucleic acid molecules of the invention or portions thereof.

The methods for in vitro or in vivo recombinational cloning of nucleic acid molecule generally relate to recombination between at least a first nucleic acid molecule having at least one recombination site and a second nucleic acid molecule having at least one recombination site to provide a chimeric nucleic acid molecule. In one aspect, the methods relate to recombination between and first vector having at least one recombination site and a second vector having at least one recombination site to provide a chimeric vector. In another aspect, a nucleic acid molecule having at least one recombination site is combined with a vector having at least one recombination site to provide a chimeric vector. In a most preferred aspect, the nucleic acid molecules or vectors used in recombination comprise two or more recombination sites. In a more specific embodiment of the invention, the recombination methods relate to a Destination Reaction (also referred to herein as an "LR reaction") in which recombination occurs between an Entry clone and a Destination Vector. Such a reaction transfers the nucleic acid molecule of interest from the Entry Clone into the Destination Vector to create an Expression Clone. The methods of the invention also specifically relate to an Entry or Gateward reaction (also referred to herein as a "BP reaction") in which an Expression Clone is recombined with a Donor vector to produce an Entry clone. In other aspects, the invention relates to methods to prepare Entry clones by combining an Entry vector with at least one nucleic acid molecule (e.g., gene or portion of a gene). The invention also relates to conversion of a desired vector into a Destination Vector by including one or more (preferably at least two) recombination sites in the vector of interest. In a more preferred aspect, a nucleic acid molecule (e.g., a cassette) having at least two recombination sites flanking a selectable marker (e.g., a toxic gene or a genetic element preventing the survival of a host cell containing that gene or element, and/or preventing replication, partition or heritability of a nucleic acid molecule (e.g., a vector or plasmid) comprising that gene or element) is added to the vector to make a Destination Vector of the invention.

Preferred vectors for use in the invention include prokaryotic vectors, eukaryotic vectors, or vectors which may shuttle between various prokaryotic and/or eukaryotic systems (e.g. shuttle vectors). Preferred prokaryotic vectors for use in the invention include but are not limited to vectors which may propagate and/or replicate in gram negative and/or gram positive bacteria, including bacteria of the genera *Escherichia, Salmonella, Proteus, Clostridium, Klebsiella, Bacillus, Streptomyces,* and *Pseudomonas* and preferably in the species *E. coli*. Eukaryotic vectors for use in the invention include vectors which propagate and/or replicate and yeast cells, plant cells, mammalian cells, (particularly human and mouse), fungal cells, insect cells, nematode cells, fish cells and the like. Particular vectors of interest include but are not limited to cloning vectors, sequencing vectors, expression vectors, fusion vectors, two-hybrid vectors, gene therapy vectors, phage display vectors, gene-targeting vectors, PACs, BACs, YACs, MACs, and reverse two-hybrid vectors. Such vectors may be used in prokaryotic and/or eukaryotic systems depending on the particular vector.

In another aspect, the invention relates to kits which may be used in carrying out the methods of the invention, and more specifically relates to cloning or subcloning kits and kits for carrying out the LR Reaction (e.g., making an Expression Clone), for carrying out the BP Reaction (e.g., making an Entry Clone), and for making Entry Clone and Destination Vector molecules of the invention. Such kits may comprise a carrier or receptacle being compartmentalized to receive and hold therein any number of containers. Such containers may contain any number of components for carrying out the methods of the invention or combinations of such components. In particular, a kit of the invention may comprise one or more components (or combinations thereof) selected from the group consisting of one or more recombination proteins or auxiliary factors or combinations thereof, one or more compositions comprising one or more recombination proteins or auxiliary factors or combinations thereof (for example, GATEWAY™ LR Clonase™ Enzyme Mix or GATEWAY™ BP Clonase™ Enzyme Mix), one or more reaction buffers, one or more nucleotides, one or more primers of the invention, one or more restriction enzymes, one or more ligases, one or more polypeptides having polymerase activity (e.g., one or more reverse transcriptases or DNA polymerases), one or more proteinases (e.g., proteinase K or other proteinases), one or more Destination Vector molecules, one or more Entry Clone molecules, one or more host cells (e.g. competent cells, such as *E. coli* cells, yeast cells, animal cells (including mammalian cells, insect cells, nematode cells, avian cells, fish cells, etc.), plant cells, and most particularly *E. coli* DB3.1 host cells, such as *E. coli* LIBRARY EFFICIENCY® DB3.1™ Competent Cells), instructions for using the kits of the invention (e.g., to carry out the methods of the invention), and the like. In related aspects, the kits of the invention may comprise one or more nucleic acid molecules encoding one or more recombination sites or portions thereof, particularly one or more nucleic acid molecules comprising a nucleotide sequence encoding the one or more recombination sites or portions thereof of the invention. Preferably, such nucleic acid molecules comprise at least two recombination sites which flank a selectable marker (e.g., a toxic gene and/or antibiotic resistance gene). In a preferred aspect, such nucleic acid molecules are in the form of a cassette (e.g., a linear nucleic acid molecule comprising one or more and preferably two or more recombination sites or portions thereof).

Kits for inserting or adding recombination sites to nucleic acid molecules of interest may comprise one or more nucleases (preferably restriction endonucleases), one or more ligases, one or more topoisomerases, one or more polymerases, and one or more nucleic acid molecules or adapters comprising one or more recombination sites. Kits for integrating recombination sites into one or more nucleic acid molecules of interest may comprise one or more components (or combinations thereof) selected from the group consisting of one or more integration sequences comprising one or more recombination sites. Such integration sequences may comprise one or more transposons, integrating viruses, homologous recombination sequences, RNA molecules, one or more host cells and the like.

Kits for making the Entry Clone molecules of the invention may comprise any or a number of components and the composition of such kits may vary depending on the specific method involved. Such methods may involve inserting the nucleic acid molecules of interest into an Entry or Donor Vector by the recombinational cloning methods of the invention, or using conventional molecular biology techniques (e.g., restriction enzyme digestion and ligation). In a preferred aspect, the Entry Clone is made using nucleic acid amplification or synthesis products. Kits for synthesizing Entry Clone molecules from amplification or synthesis products may comprise one or more components (or combinations thereof) selected from the group consisting of one or more Donor Vectors (e.g., one or more attP vectors including, but not limited to, pDONR201 (FIG. 49), pDONR202 (FIG. 50), pDONR203 (FIG. 51), pDONR204 (FIG. 52), pDONR205 (FIG. 53), pDONR206 (FIG. 53), and the like), one or more polypeptides having polymerase activity (preferably DNA polymerases and most preferably thermostable DNA polymerases), one or more proteinases, one or more reaction buffers, one or more nucleotides, one or more primers comprising one or more recombination sites or portions thereof, and instructions for making one or more Entry Clones.

Kits for making the Destination vectors of the invention may comprise any number of components and the compositions of such kits may vary depending on the specific method involved. Such methods may include the recombination methods of the invention or conventional molecular biology techniques (e.g., restriction endonuclease digestion and ligation). In a preferred aspect, the Destination vector is made by inserting a nucleic acid molecule comprising at least one recombination site (or portion thereof) of the invention (preferably a nucleic acid molecule comprising at least two recombination sites or portions thereof flanking a selectable marker) into a desired vector to convert the desired vector into a Destination vector of the invention. Such kits may comprise at least one component (or combinations thereof) selected from the group consisting of one or more restriction endonucleases, one or more ligases, one or more polymerases, one or more nucleotides, reaction buffers, one or more nucleic acid molecules comprising at least one recombination site or portion thereof (preferably at least one nucleic acid molecule comprising at least two recombination sites flanking at least one selectable marker, such as a cassette comprising at least one selectable marker such as antibiotic resistance genes and/or toxic genes), and instructions for making such Destination vectors.

The invention also relates to kits for using the antibodies of the invention in identification and/or isolation of peptides and proteins (which may be fusion proteins) produced by the nucleic acid molecules of the invention, and for identification and/or isolation of the nucleic acid molecules of the invention or portions thereof. Such kits may comprise one or more components (or combination thereof) selected from the group consisting of one or more antibodies of the invention, one or more detectable labels, one or more solid supports and the like.

Other preferred embodiments of the present invention will be apparent to one of ordinary skill in light of what is known in the art, in light of the following drawings and description of the invention, and in light of the claims.

BRIEF DESCRIPTION OF THE DRAWINGS

FIG. 5 is a more detailed schematic depiction of the LR ("Destination") reaction (FIG. 5A) and the BP ("Entry" or "Gateward") reaction (FIG. 5B) of the GATEWAY™ Cloning System, showing the reactants, products and byproducts of each reaction.

FIG. 6 shows the sequences of the attB1 (nucleotide sequence disclosed as SEQ ID NO: 298 and coded amino acid sequence disclosed as SEQ ID NO 299) and attB2 (nucleotide sequence disclosed as SEQ ID NO: 300 and coded amino acid sequence disclosed as SEQ ID NO: 301) sites flanking a gene of interest after subcloning into a Destination Vector to create an Expression Clone.

FIG. 7 is a schematic depiction of four ways to make Entry Clones using the compositions and methods of the invention: 1. using restriction enzymes and ligase; 2. starting with a cDNA library prepared in an attL Entry Vector; 3. using an Expression Clone from a library prepared in an attB Expression Vector via the B×P reaction; and 4. recombinational cloning of PCR fragments with terminal attB sites, via the B×P reaction. Approaches 3 and 4 rely on recombination with a Donor vector (here, an attP vector such as pDONR201 (see FIGS. 49A-C), pDONR202 (see FIGS. 50A-C), pDONR203 (see FIGS. 51A-C), pDONR204 (see FIGS. 52A-C), pDONR205 (see FIGS. 53A-C), or pDONR206 (see FIGS. 54A-C), for example) that provides an Entry Clone carrying a selection marker such as kan$^r$, gen$^r$, tet$^r$, or the like.

FIG. 9 is a listing of the nucleotide sequences of the recombination sites designated herein as attB1, attB2, attP1, attP2, attL1, attL2, attR1 and attR2 (SEQ ID NOs:1-8, respectively). Sequences are written conventionally, from 5' to 3'.

FIGS. 10-20: The plasmid backbone for all the Entry Vectors depicted herein is the same, and is shown in FIG. 10A for the Entry Vector pENTR1A. For other Entry Vectors shown in FIGS. 11-20, only the sequences shown in FIG. "A" for each figure set (i.e., FIG. 11A, FIG. 12A, etc.) are different (within the attL1-attL2 cassettes) from those shown in FIG. 10—the plasmid backbone is identical.

FIG. 10 is a schematic depiction of the physical map and cloning sites (FIG. 10A) (SEQ ID NOS 185-187, respectively, in order of appearance), and the nucleotide sequence (FIG. 10B) (SEQ ID NO:118), of the Entry Vector pENTR1A.

FIG. 11 is a schematic depiction of the cloning sites (FIG. 11A) (SEQ ID NOS 188-191, respectively, in order of appearance) and the nucleotide sequence (FIG. 11B) (SEQ ID NO:119) of the Entry Vector pENTR2B.

FIG. 12 is a schematic depiction of the cloning sites (FIG. 12A) (SEQ ID NOS 192-195, respectively, in order of appearance) and the nucleotide sequence (FIG. 12B) (SEQ ID NO:120) of the Entry Vector pENTR3C.

FIG. 13 is a schematic depiction of the cloning sites (FIG. 13A) (SEQ ID NOS 196-199, respectively, in order of appearance) and the nucleotide sequence (FIG. 13B) (SEQ ID NO:121) of the Entry Vector pENTR4.

FIG. 14 is a schematic depiction of the cloning sites (FIG. 14A) (SEQ ID NOS 200-202, respectively, in order of appearance) and the nucleotide sequence (FIG. 14B) (SEQ ID NO:122) of the Entry Vector pENTR5.

FIG. 15 is a schematic depiction of the cloning sites (FIG. 15A) (SEQ ID NOS 203-205, respectively, in order of appearance) and the nucleotide sequence (FIG. 15B) (SEQ ID NO:123) of the Entry Vector pENTR6.

FIG. 16 is a schematic depiction of the cloning sites (FIG. 16A) (SEQ ID NOS 206-208, respectively, in order of appearance) and the nucleotide sequence (FIG. 16B) (SEQ ID NO:124) of the Entry Vector pENTR7.

FIG. 17 is a schematic depiction of the cloning sites (FIG. 17A) (SEQ ID NOS 209-211, respectively, in order of appearance) and the nucleotide sequence (FIG. 17B) (SEQ ID NO:125) of the Entry Vector pENTR8.

FIG. 18 is a schematic depiction of the cloning sites (FIG. 18A) (SEQ ID NOS 212-214, respectively, in order of appearance) and the nucleotide sequence (FIG. 18B) (SEQ ID NO:126) of the Entry Vector pENTR9.

FIG. 19 is a schematic depiction of the cloning sites (FIG. 19A) (SEQ ID NOS 215-217, respectively, in order of appearance) and the nucleotide sequence (FIG. 19B) (SEQ ID NO:127) of the Entry Vector pENTR10.

FIG. 20 is a schematic depiction of the cloning sites (FIG. 20A) (SEQ ID NOS 218-221, respectively, in order of appearance) and the nucleotide sequence (FIG. 20B) (SEQ ID NO:128) of the Entry Vector pENTR11.

FIG. 24 is a schematic depiction of the physical map and the His6-Trx expression cassette (FIG. 24A) (SEQ ID NOS 229-230, 303 and 302, respectively, in order of appearance) showing the promoter sequences at −35 and at −10 from the initiation codon and a TEV protease cleavage site, and the nucleotide sequence (FIGS. 24B-D) (SEQ ID NO:132), of Destination Vector pDEST4. This vector may also be referred to as pTrx-DEST4.

FIG. 28 is a schematic depiction of the attR1 site, baculovirus polyhedrin promoter, and the physical map (FIG. 28A) (SEQ ID NO: 236), and the nucleotide sequence (FIGS. 28B-D) (SEQ ID NO:136), of Destination Vector pDEST8. This vector may also be referred to as pFastBac-DEST8.

FIG. 29 is a schematic depiction of the attR1 site, Semliki Forest Virus promoter, and the physical map (FIG. 29A) (SEQ ID NO: 237), and the nucleotide sequence (FIGS. 29B-E) (SEQ ID NO:137), of Destination Vector pDEST9. This vector may also be referred to as pSFV-DEST9.

FIG. 31 is a schematic depiction of the attR1 cassette containing a tetracycline-regulated CMV promoter and the physical map (FIG. 31A) (SEQ ID NO: 240), and the nucleotide sequence (FIGS. 31B-D) (SEQ ID NO:139), of Destination Vector pDEST11. This vector may also be referred to as pTet-DEST11.

FIG. 32 is a schematic depiction of the attR1 site, the start of the mRNA of the CMV promoter, and the physical map (FIG. 32A) (SEQ ID NO: 241), and the nucleotide sequence (FIGS. 32B-D) (SEQ ID NO:140), of Destination Vector pDEST12.2. This vector may also be referred to as pCMV-neo-DEST12, as pCMV-DEST12, or as pDEST12.

FIG. 33 is a schematic depiction of the attR1 site, the $\lambda P_L$ promoter, and the physical map (FIG. 33A) (SEQ ID NO: 242), and the nucleotide sequence (FIGS. 33B-C) (SEQ ID NO:141), of Destination Vector pDEST13. This vector may also be referred to as p$\lambda P_L$-DEST13.

FIG. 38 is a schematic depiction of the attR1 site and the p10 baculovirus promoter, and the physical map (FIG. 38A) (SEQ ID NO: 254), and the nucleotide sequence (FIGS. 38B-D) (SEQ ID NO:146), of Destination Vector pDEST18. This vector may also be referred to as pFBp10-DEST18.

FIG. 39 is a schematic depiction of the attR1 site, and the 39k baculovirus promoter, and the physical map (FIG. 39A) (SEQ ID NO: 255), and the nucleotide sequence (FIGS. 39B-D) (SEQ ID NO:147), of Destination Vector pDEST19. This vector may also be referred to as pFB39k-DEST19.

FIG. 40 is a schematic depiction of the attR1 site, the polh baculovirus promoter, and the N-terminal GST fusion sequence, and the physical map (FIG. 40A) (SEQ ID NOS 256-257, 259 and 258, respectively, in order of appearance), and the nucleotide sequence (FIGS. 40B-D) (SEQ ID NO:148), of Destination Vector pDEST20. This vector may also be referred to as pFB GST-DEST20.

FIG. 44 is a schematic depiction of the attR1 and attR2 sites, the T7 promoter, and the C-terminal GST fusion sequence, and the physical map (FIG. 44A) (SEQ ID NOS 271, 273 and 272, respectively, in order of appearance), and the nucleotide sequence (FIGS. 44B-D) (SEQ ID NO:152), of Destination Vector pDEST24. This vector may also be referred to as pC-term-GST-DEST24.

FIG. 45 is a schematic depiction of the attR1 and attR2 sites, the T7 promoter, and the C-terminal thioredoxin fusion sequence, and the physical map (FIG. 45A) (SEQ ID NOS 274, 276 and 275, respectively, in order of appearance), and the nucleotide sequence (FIGS. 45B-D) (SEQ ID NO:153), of Destination Vector pDEST25. This vector may also be referred to as pC-term-Trx-DEST25.

FIG. 46 is a schematic depiction of the attR1 site, the CMV promoter, and an N-terminal His6 fusion sequence, and the physical map (FIG. 46A) (SEQ ID NOS 277-278, respectively, in order of appearance), and the nucleotide sequence (FIG. 46B-D) (SEQ ID NO:154), of Destination Vector pDEST26. This vector may also be referred to as pCMV-SPneo-His-DEST26.

FIG. 55 depicts the attB1 site (SEQ ID NOS 285 and 284, respectively, in order of appearance), and the physical map, of an Entry Clone (pENTR7) of CAT subcloned into the Destination Vector pDEST2 (FIG. 22).

FIG. 62 is a depiction of native and fusion protein expression using the recombinational cloning methods and compositions of the invention. In the upper figure depicting native protein expression, all of the translational start signals are included between the attB1 and attB2 sites; therefore, these signals must be present in the starting Entry Clone. The lower figure depicts fusion protein expression (here showing expression with both N-terminal and C-terminal fusion tags so that ribosomes read through attB1 and attB2 to create the fusion protein). Unlike native protein expression vectors, N-terminal fusion vectors have their translational start signals upstream of the attB1 site.

FIG. 64 shows the physical maps of plasmids containing three attR reading frame cassettes, pEZC15101 (reading frame A.

FIG. 66 is a table listing the results of recombinational cloning of the tetr and amp$^r$ PCR products made using the primers shown in FIG. 65.

FIG. 77 is a table summarizing the results of the PCR product cloning efficiency experiments depicted in FIGS. 69-74, for PCR fragments ranging in size from 0.256 kb to 6.9 kb.

FIG. 79 is a depiction of several different attR cassettes (SEQ ID NOs: 171-173) (in reading frames A, B, or C) which may provide fusion codons at the amino-terminus of the encoded protein.

DETAILED DESCRIPTION OF THE INVENTION

Definitions

In the description that follows, a number of terms used in recombinant DNA technology are utilized extensively. In order to provide a clear and consistent understanding of the specification and claims, including the scope to be given such terms, the following definitions are provided.

Byproduct: is a daughter molecule (a new clone produced after the second recombination event during the recombinational cloning process) lacking the segment which is desired to be cloned or subcloned.

Cointegrate: is at least one recombination intermediate nucleic acid molecule of the present invention that contains both parental (starting) molecules. It will usually be linear. In some embodiments it can be circular. RNA and polypeptides may be expressed from cointegrates using an appropriate host cell strain, for example E. coli DB3.1 (particularly E. coli LIBRARY EFFICIENCY® DB3.1™ Competent Cells), and selecting for both selection markers found on the cointegrate molecule.

Host: is any prokaryotic or eukaryotic organism that can be a recipient of the recombinational cloning Product, vector, or nucleic acid molecule of the invention. A "host," as the term is used herein, includes prokaryotic or eukaryotic organisms that can be genetically engineered. For examples of such hosts, see Maniatis et al., *Molecular Cloning: A Laboratory Manual*, Cold Spring Harbor Laboratory, Cold Spring Harbor, N.Y. (1982).

Insert or Inserts: include the desired nucleic acid segment or a population of nucleic acid segments (segment A of FIG. 1) which may be manipulated by the methods of the present invention. Thus, the terms Insert(s) are meant to include a particular nucleic acid (preferably DNA) segment or a population of segments. Such Insert(s) can comprise one or more nucleic acid molecules.

Insert Donor: is one of the two parental nucleic acid molecules (e.g. RNA or DNA) of the present invention which carries the Insert. The Insert Donor molecule comprises the Insert flanked on both sides with recombination sites. The Insert Donor can be linear or circular. In one embodiment of the invention, the Insert Donor is a circular DNA molecule and further comprises a cloning vector sequence outside of the recombination signals (see FIG. 1). When a population of Inserts or population of nucleic acid segments are used to make the Insert Donor, a population of Insert Donors results and may be used in accordance with the invention. Examples of such Insert Donor molecules are GATEWAY™ Entry Vectors, which include but are not limited to those Entry Vectors depicted in FIGS. 10-20, as well as other vectors comprising a gene of interest flanked by one or more attL sites (e.g., attL1, attL2, etc.), or by one or more attB sites (e.g., attB1, attB2, etc.) for the production of library clones.

Figure 1:
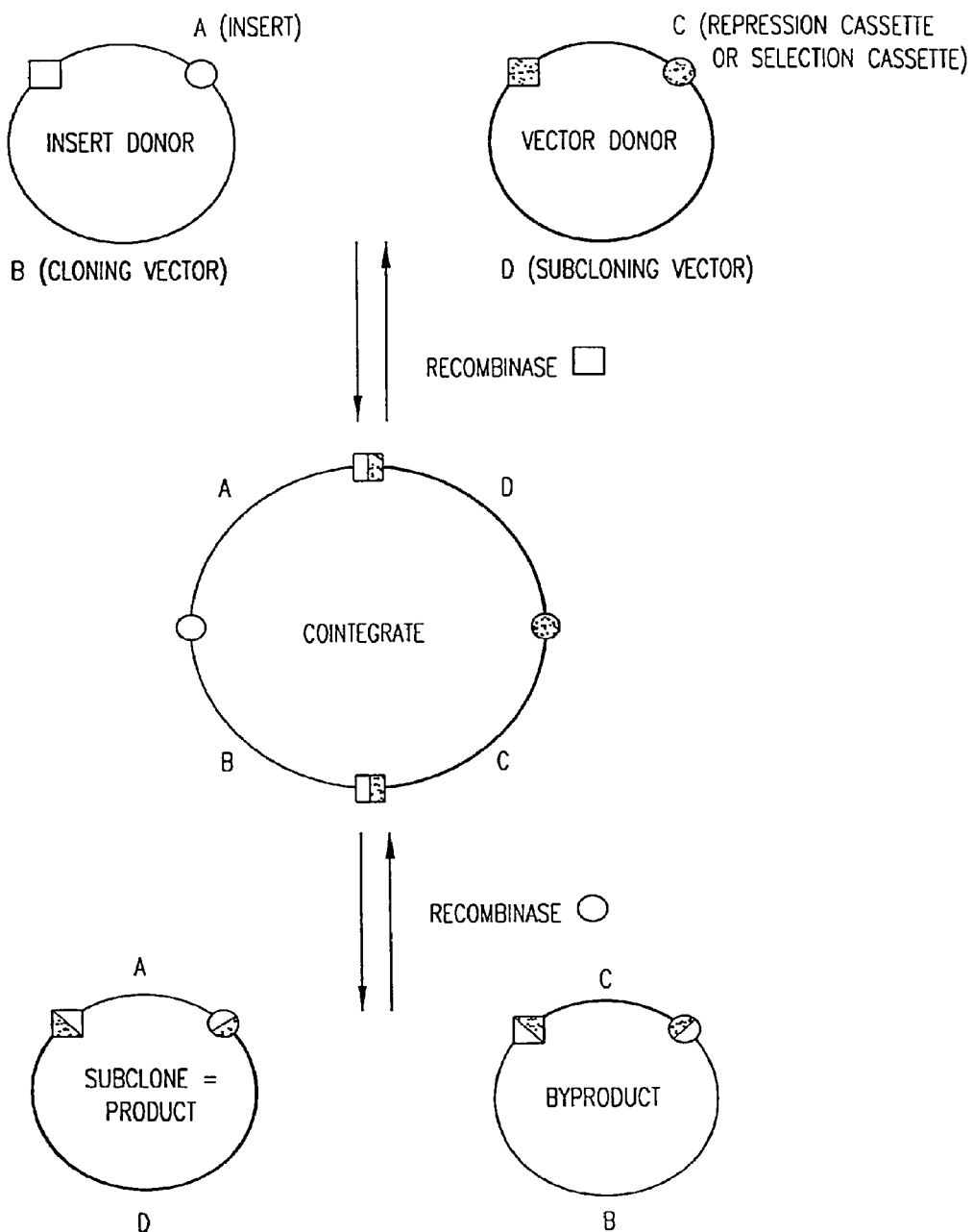
FIG. 1 depicts one general method of the present invention, wherein the starting (parent) DNA molecules can be circular or linear. The goal is to exchange the new subcloning vector D for the original cloning vector B. It is desirable in one embodiment to select for AD and against all the other molecules, including the Cointegrate. The square and circle are sites of recombination: e.g., lox (such as loxP) sites, att sites, etc. For example, segment D can contain expression signals, protein fusion domains, new drug markers, new origins of replication, or specialized functions for mapping or sequencing DNA. It should be noted that the cointegrate molecule contains Segment D (Destination vector) adjacent to segment A (Insert), thereby juxtaposing functional elements in D with the insert in A. Such molecules can be used directly in vitro (e.g., if a promoter is positioned adjacent to a gene—for in vitro transcription/translation) or in vivo (following isolation in a cell capable of propagating ccdB-containing vectors) by selecting for the selection markers in Segments B+D. As one skilled in the art will recognize, this single step method has utility in certain envisioned applications of the invention.

Product: is one of the desired daughter molecules comprising the A and D sequences which is produced after the second recombination event during the recombinational cloning process (see FIG. 1). The Product contains the nucleic acid which was to be cloned or subcloned. In accordance with the invention, when a population of Insert Donors are used, the resulting population of Product molecules will contain all or a portion of the population of Inserts of the Insert Donors and preferably will contain a representative population of the original molecules of the Insert Donors.

Promoter: is a DNA sequence generally described as the 5'-region of a gene, located proximal to the start codon. The transcription of an adjacent DNA segment is initiated at the promoter region. A repressible promoter's rate of transcription decreases in response to a repressing agent. An inducible promoter's rate of transcription increases in response to an inducing agent. A constitutive promoter's rate of transcription is not specifically regulated, though it can vary under the influence of general metabolic conditions.

Recognition sequence: Recognition sequences are particular sequences which a protein, chemical compound, DNA, or RNA molecule (e.g., restriction endonuclease, a modification methylase, or a recombinase) recognizes and binds. In the present invention, a recognition sequence will usually refer to a recombination site. For example, the recognition sequence for Cre recombinase is loxP which is a 34 base pair sequence comprised of two 13 base pair inverted repeats (serving as the recombinase binding sites) flanking an 8 base pair core sequence. See FIG. 1 of Sauer, B., *Current Opinion in Biotechnology* 5:521-527 (1994). Other examples of recognition sequences are the attB, attP, attL, and attR sequences which are recognized by the recombinase enzyme λ Integrase. attB is an approximately 25 base pair sequence containing two 9 base pair core-type Int binding sites and a 7 base pair overlap region. attP is an approximately 240 base pair sequence containing core-type Int binding sites and arm-type Int binding sites as well as sites for auxiliary proteins integration host factor (IHF), FIS and excisionase (Xis). See Landy, *Current Opinion in Biotechnology* 3:699-707 (1993). Such sites may also be engineered according to the present invention to enhance production of products in the methods of the invention. When such engineered sites lack the P1 or H1 domains to make the recombination reactions irreversible (e.g., attR or attP), such sites may be designated attR' or attP' to show that the domains of these sites have been modified in some way.

Recombination proteins: include excisive or integrative proteins, enzymes, co-factors or associated proteins that are involved in recombination reactions involving one or more recombination sites, which may be wild-type proteins (See Landy, *Current Opinion in Biotechnology* 3:699-707 (1993)), or mutants, derivatives (e.g., fusion proteins containing the recombination protein sequences or fragments thereof), fragments, and variants thereof.

Recombination site: is a recognition sequence on a DNA molecule participating in an integration/recombination reaction by the recombinational cloning methods of the invention. Recombination sites are discrete sections or segments of DNA on the participating nucleic acid molecules that are recognized and bound by a site-specific recombination protein during the initial stages of integration or recombination. For example, the recombination site for Cre recombinase is loxP which is a 34 base pair sequence comprised of two 13 base pair inverted repeats (serving as the recombinase binding sites) flanking an 8 base pair core sequence. See FIG. 1 of Sauer, B., *Curr. Opin. Biotech.* 5:521-527 (1994). Other examples of recognition sequences include the attB, attP, attL, and attR sequences described herein, and mutants, fragments, variants and derivatives thereof, which are recognized by the recombination protein λ Int and by the auxiliary proteins integration host factor (IHF), FIS and excisionase (Xis). See Landy, *Curr. Opin. Biotech.* 3:699-707 (1993).

Recombinational Cloning: is a method described herein, whereby segments of nucleic acid molecules or populations of such molecules are exchanged, inserted, replaced, substituted or modified, in vitro or in vivo. By "in vitro" and "in vivo" herein is meant recombinational cloning that is carried out outside of host cells (e.g., in cell-free systems) or inside of host cells (e.g., using recombination proteins expressed by host cells), respectively.

Repression cassette: is a nucleic acid segment that contains a repressor or a Selectable marker present in the subcloning vector.

Selectable marker: is a DNA segment that allows one to select for or against a molecule (e.g., a replicon) or a cell that contains it, often under particular conditions. These markers can encode an activity, such as, but not limited to, production of RNA, peptide, or protein, or can provide a binding site for RNA, peptides, proteins, inorganic and organic compounds or compositions and the like. Examples of Selectable markers include but are not limited to: (1) DNA segments that encode products which provide resistance against otherwise toxic compounds (e.g., antibiotics); (2) DNA segments that encode products which are otherwise lacking in the recipient cell (e.g., tRNA genes, auxotrophic markers); (3) DNA segments that encode products which suppress the activity of a gene product; (4) DNA segments that encode products which can be readily identified (e.g., phenotypic markers such as β-galactosidase, green fluorescent protein (GFP), and cell surface proteins); (5) DNA segments that bind products which are otherwise detrimental to cell survival and/or function; (6) DNA segments that otherwise inhibit the activity of any of the DNA segments described in Nos. 1-5 above (e.g., antisense oligonucleotides); (7) DNA segments that bind products that modify a substrate (e.g. restriction endonucleases); (8) DNA segments that can be used to isolate or identify a desired molecule (e.g. specific protein binding sites); (9) DNA segments that encode a specific nucleotide sequence which can be otherwise non-functional (e.g., for PCR amplification of subpopulations of molecules); (10) DNA segments, which when absent, directly or indirectly confer resistance or sensitivity to particular compounds; (11) DNA segments that encode products which are toxic in recipient cells; (12) DNA segments that inhibit replication, partition or heritability of nucleic acid molecules that contain them; and/or (13) DNA segments that encode conditional replication functions, e.g., replication in certain hosts or host cell strains or under certain environmental conditions (e.g., temperature, nutritional conditions, etc.).

Selection scheme: is any method which allows selection, enrichment, or identification of a desired Product or Product(s) from a mixture containing an Entry Clone or Vector, a Destination Vector, a Donor Vector, an Expression Clone or Vector, any intermediates (e.g. a Cointegrate or a replicon), and/or Byproducts. The selection schemes of one preferred embodiment have at least two components that are either linked or unlinked during recombinational cloning. One component is a Selectable marker. The other component controls the expression in vitro or in vivo of the Selectable marker, or survival of the cell (or the nucleic acid molecule, e.g., a replicon) harboring the plasmid carrying the Selectable marker. Generally, this controlling element will be a repressor or inducer of the Selectable marker, but other means for controlling expression or activity of the Selectable marker can be used. Whether a repressor or activator is used will depend on whether the marker is for a positive or negative selection, and the exact arrangement of the various DNA segments, as will be readily apparent to those skilled in the art. A preferred requirement is that the selection scheme results in selection of or enrichment for only one or more desired Products. As defined herein, selecting for a DNA molecule includes (a) selecting or enriching for the presence of the desired DNA molecule, and (b) selecting or enriching against the presence of DNA molecules that are not the desired DNA molecule.

In one embodiment, the selection schemes (which can be carried out in reverse) will take one of three forms, which will be discussed in terms of FIG. 1. The first, exemplified herein with a Selectable marker and a repressor therefore, selects for molecules having segment D and lacking segment C. The second selects against molecules having segment C and for molecules having segment D. Possible embodiments of the second form would have a DNA segment carrying a gene toxic to cells into which the in vitro reaction products are to be introduced. A toxic gene can be a DNA that is expressed as a toxic gene product (a toxic protein or RNA), or can be toxic in and of itself. (In the latter case, the toxic gene is understood to carry its classical definition of "heritable trait".)

Examples of such toxic gene products are well known in the art, and include, but are not limited to, restriction endonucleases (e.g., DpnI), apoptosis-related genes (e.g. ASK1 or members of the bcl-2/ced-9 family), retroviral genes including those of the human immunodeficiency virus (HIV), defensins such as NP-1, inverted repeats or paired palindromic DNA sequences, bacteriophage lytic genes such as those from ΦX174 or bacteriophage T4; antibiotic sensitivity genes such as rpsL, antimicrobial sensitivity genes such as pheS, plasmid killer genes, eukaryotic transcriptional vector genes that produce a gene product toxic to bacteria, such as GATA-1, and genes that kill hosts in the absence of a suppressing function, e.g., kicB, ccdB, ΦX174 E (Liu, Q. et al., Curr. Biol. 8:1300-1309 (1998)), and other genes that negatively affect replicon stability and/or replication. A toxic gene can alternatively be selectable in vitro, e.g., a restriction site.

Many genes coding for restriction endonucleases operably linked to inducible promoters are known, and may be used in the present invention. See, e.g. U.S. Pat. Nos. 4,960,707 (DpnI and DpnII); 5,000,333, 5,082,784 and 5,192,675 (KpnI); 5,147,800 (NgoAIII and NgoAI); 5,179,015 (FspI and HaeIII): 5,200,333 (HaeII and TaqI); 5,248,605 (HpaII); 5,312,746 (ClaI); 5,231,021 and 5,304,480 (XhoI and XhoII); 5,334,526 (AluI); 5,470,740 (NsiI); 5,534,428 (SstI/SacI); 5,202,248 (NcoI); 5,139,942 (NdeI); and 5,098,839 (PacI). See also Wilson, G. G., Nucl. Acids Res. 19:2539-2566 (1991); and Lunnen, K. D., et al., Gene 74:25-32 (1988).

In the second form, segment D carries a Selectable marker. The toxic gene would eliminate transformants harboring the Vector Donor, Cointegrate, and Byproduct molecules, while the Selectable marker can be used to select for cells containing the Product and against cells harboring only the Insert Donor.

The third form selects for cells that have both segments A and D in cis on the same molecule, but not for cells that have both segments in trans on different molecules. This could be embodied by a Selectable marker that is split into two inactive fragments, one each on segments A and D.

The fragments are so arranged relative to the recombination sites that when the segments are brought together by the recombination event, they reconstitute a functional Selectable marker. For example, the recombinational event can link a promoter with a structural nucleic acid molecule (e.g., a gene), can link two fragments of a structural nucleic acid molecule, or can link nucleic acid molecules that encode a heterodimeric gene product needed for survival, or can link portions of a replicon.

Site-specific recombinase: is a type of recombinase which typically has at least the following four activities (or combinations thereof): (1) recognition of one or two specific nucleic acid sequences; (2) cleavage of said sequence or sequences; (3) topoisomerase activity involved in strand exchange; and (4) ligase activity to reseal the cleaved strands of nucleic acid. See Sauer, B., Current Opinions in Biotechnology 5:521-527 (1994). Conservative site-specific recombination is distinguished from homologous recombination and transposition by a high degree of sequence specificity for both partners. The strand exchange mechanism involves the cleavage and rejoining of specific DNA sequences in the absence of DNA synthesis (Landy, A. (1989) *Ann. Rev. Biochem.* 58:913-949).

Subcloning vector: is a cloning vector comprising a circular or linear nucleic acid molecule which includes preferably an appropriate replicon. In the present invention, the subcloning vector (segment D in FIG. 1) can also contain functional and/or regulatory elements that are desired to be incorporated into the final product to act upon or with the cloned DNA Insert (segment A in FIG. 1). The subcloning vector can also contain a Selectable marker (preferably DNA).

Vector: is a nucleic acid molecule (preferably DNA) that provides a useful biological or biochemical property to an Insert. Examples include plasmids, phages, autonomously replicating sequences (ARS), centromeres, and other sequences which are able to replicate or be replicated in vitro or in a host cell, or to convey a desired nucleic acid segment to a desired location within a host cell. A Vector can have one or more restriction endonuclease recognition sites at which the sequences can be cut in a determinable fashion without loss of an essential biological function of the vector, and into which a nucleic acid fragment can be spliced in order to bring about its replication and cloning. Vectors can further provide primer sites, e.g., for PCR, transcriptional and/or translational initiation and/or regulation sites, recombinational signals, replicons, Selectable markers, etc. Clearly, methods of inserting a desired nucleic acid fragment which do not require the use of homologous recombination, transpositions or restriction enzymes (such as, but not limited to, UDG cloning of PCR fragments (U.S. Pat. No. 5,334,575, entirely incorporated herein by reference), T:A cloning, and the like) can also be applied to clone a fragment into a cloning vector to be used according to the present invention. The cloning vector can further contain one or more selectable markers suitable for use in the identification of cells transformed with the cloning vector.

Vector Donor: is one of the two parental nucleic acid molecules (e.g. RNA or DNA) of the present invention which carries the DNA segments comprising the DNA vector which is to become part of the desired Product. The Vector Donor comprises a subcloning vector D (or it can be called the cloning vector if the Insert Donor does not already contain a cloning vector (e.g., for PCR fragments containing attB sites; see below)) and a segment C flanked by recombination sites (see FIG. 1). Segments C and/or D can contain elements that contribute to selection for the desired Product daughter molecule, as described above for selection schemes. The recombination signals can be the same or different, and can be acted upon by the same or different recombinases. In addition, the Vector Donor can be linear or circular. Examples of such Vector Donor molecules include GATEWAY™ Destination Vectors, which include but are not limited to those Destination Vectors depicted in FIGS. 21-47 and 90-96.

Primer: refers to a single stranded or double stranded oligonucleotide that is extended by covalent bonding of nucleotide monomers during amplification or polymerization of a nucleic acid molecule (e.g. a DNA molecule). In a preferred aspect, a primer comprises one or more recombination sites or portions of such recombination sites. Portions of recombination sites comprise at least 2 bases (or basepairs, abbreviated herein as "bp"), at least 5-200 bases, at least 10-100 bases, at least 15-75 bases, at least 15-50 bases, at least 15-25 bases, or at least 16-25 bases, of the recombination sites of interest, as described in further detail below and in the Examples. When using portions of recombination sites, the missing portion of the recombination site may be provided as a template by the newly synthesized nucleic acid molecule. Such recombination sites may be located within and/or at one or both termini of the primer. Preferably, additional sequences are added to the primer adjacent to the recombination site(s) to enhance or improve recombination and/or to stabilize the recombination site during recombination. Such stabilization sequences may be any sequences (preferably G/C rich sequences) of any length. Preferably, such sequences range in size from 1 to about 1000 bases, 1 to about 500 bases, and 1 to about 100 bases, 1 to about 60 bases, 1 to about 25, 1 to about 10, 2 to about 10 and preferably about 4 bases. Preferably, such sequences are greater than 1 base in length and preferably greater than 2 bases in length.

Template: refers to double stranded or single stranded nucleic acid molecules which are to be amplified, synthesized or sequenced. In the case of double stranded molecules, denaturation of its strands to form a first and a second strand is preferably performed before these molecules will be amplified, synthesized or sequenced, or the double stranded molecule may be used directly as a template. For single stranded templates, a primer complementary to a portion of the template is hybridized under appropriate conditions and one or more polypeptides having polymerase activity (e.g. DNA polymerases and/or reverse transcriptases) may then synthesize a nucleic acid molecule complementary to all or a portion of said template. Alternatively, for double stranded templates, one or more promoters may be used in combination with one or more polymerases to make nucleic acid molecules complementary to all or a portion of the template. The newly synthesized molecules, according to the invention, may be equal or shorter in length than the original template. Additionally, a population of nucleic acid templates may be used during synthesis or amplification to produce a population of nucleic acid molecules typically representative of the original template population.

Adapter: is an oligonucleotide or nucleic acid fragment or segment (preferably DNA) which comprises one or more recombination sites (or portions of such recombination sites) which in accordance with the invention can be added to a circular or linear Insert Donor molecule as well as other nucleic acid molecules described herein. When using portions of recombination sites, the missing portion may be provided by the Insert Donor molecule. Such adapters may be added at any location within a circular or linear molecule, although the adapters are preferably added at or near one or both termini of a linear molecule. Preferably, adapters are positioned to be located on both sides (flanking) a particular nucleic acid molecule of interest. In accordance with the invention, adapters may be added to nucleic acid molecules of interest by standard recombinant techniques (e.g. restriction digest and ligation). For example, adapters may be added to a circular molecule by first digesting the molecule with an appropriate restriction enzyme, adding the adapter at the cleavage site and reforming the circular molecule which contains the adapter(s) at the site of cleavage. In other aspects, adapters may be added by homologous recombination, by integration of RNA molecules, and the like. Alternatively, adapters may be ligated directly to one or more and preferably both termini of a linear molecule thereby resulting in linear molecule(s) having adapters at one or both termini. In one aspect of the invention, adapters may be added to a population of linear molecules, (e.g. a cDNA library or genomic DNA which has been cleaved or digested) to form a population of linear molecules containing adapters at one and preferably both termini of all or substantial portion of said population.

Adapter-Primer: is primer molecule which comprises one or more recombination sites (or portions of such recombination sites) which in accordance with the invention can be added to a circular or linear nucleic acid molecule described herein. When using portions of recombination sites, the missing portion may be provided by a nucleic acid molecule (e.g., an adapter) of the invention. Such adapter-primers may be added at any location within a circular or linear molecule, although the adapter-primers are preferably added at or near one or both termini of a linear molecule. Examples of such adapter-primers and the use thereof in accordance with the methods of the invention are shown in Example 25 herein. Such adapter-primers may be used to add one or more recombination sites or portions thereof to circular or linear nucleic acid molecules in a variety of contexts and by a variety of techniques, including but not limited to amplification (e.g., PCR), ligation (e.g., enzymatic or chemical/synthetic ligation), recombination (e.g., homologous or non-homologous (illegitimate) recombination) and the like.

Library: refers to a collection of nucleic acid molecules (circular or linear). In one embodiment, a library may comprise a plurality (i.e., two or more) of DNA molecules, which may or may not be from a common source organism, organ, tissue, or cell. In another embodiment, a library is representative of all or a portion or a significant portion of the DNA content of an organism (a "genomic" library), or a set of nucleic acid molecules representative of all or a portion or a significant portion of the expressed nucleic acid molecules (a cDNA library) in a cell, tissue, organ or organism. A library may also comprise random sequences made by de novo synthesis, mutagenesis of one or more sequences and the like. Such libraries may or may not be contained in one or more vectors.

Amplification: refers to any in vitro method for increasing a number of copies of a nucleotide sequence with the use of a polymerase. Nucleic acid amplification results in the incorporation of nucleotides into a DNA and/or RNA molecule or primer thereby forming a new molecule complementary to a template. The formed nucleic acid molecule and its template can be used as templates to synthesize additional nucleic acid molecules. As used herein, one amplification reaction may consist of many rounds of replication. DNA amplification reactions include, for example, polymerase chain reaction (PCR). One PCR reaction may consist of 5-100 "cycles" of denaturation and synthesis of a DNA molecule.

Oligonucleotide: refers to a synthetic or natural molecule comprising a covalently linked sequence of nucleotides which are joined by a phosphodiester bond between the 3' position of the deoxyribose or ribose of one nucleotide and the 5' position of the deoxyribose or ribose of the adjacent nucleotide. This term may be used interchangeably herein with the terms "nucleic acid molecule" and "polynucleotide," without any of these terms necessarily indicating any particular length of the nucleic acid molecule to which the term specifically refers.

Nucleotide: refers to a base-sugar-phosphate combination. Nucleotides are monomeric units of a nucleic acid molecule (DNA and RNA). The term nucleotide includes ribonucleoside triphosphates ATP, UTP, CTG, GTP and deoxyribonucleoside triphosphates such as dATP, dCTP, dITP, dUTP, dGTP, dTTP, or derivatives thereof. Such derivatives include, for example, [αS]dATP, 7-deaza-dGTP and 7-deaza-dATP. The term nucleotide as used herein also refers to dideoxyribonucleoside triphosphates (ddNTPs) and their derivatives. Illustrated examples of dideoxyribonucleoside triphosphates include, but are not limited to, ddATP, ddCTP, ddGTP, ddITP, and ddTTP. According to the present invention, a "nucleotide" may be unlabeled or detectably labeled by well known techniques. Detectable labels include, for example, radioactive isotopes, fluorescent labels, chemiluminescent labels, bioluminescent labels and enzyme labels.

Hybridization: The terms "hybridization" and "hybridizing" refers to base pairing of two complementary single-stranded nucleic acid molecules (RNA and/or DNA) to give a double stranded molecule. As used herein, two nucleic acid molecules may be hybridized, although the base pairing is not completely complementary. Accordingly, mismatched bases do not prevent hybridization of two nucleic acid molecules provided that appropriate conditions, well known in the art, are used. In some aspects, hybridization is said to be under "stringent conditions." By "stringent conditions" as used herein is meant overnight incubation at 42° C. in a solution comprising: 50% formamide, 5×SSC (150 mM NaCl, 15 mM trisodium citrate), 50 mM sodium phosphate (pH 7.6), 5×Denhardt's solution, 10% dextran sulfate, and 20 g/ml denatured, sheared salmon sperm DNA, followed by washing the filters in 0.1×SSC at about 65° C.

Other terms used in the fields of recombinant DNA technology and molecular and cell biology as used herein will be generally understood by one of ordinary skill in the applicable arts.

Overview

Figure 2:
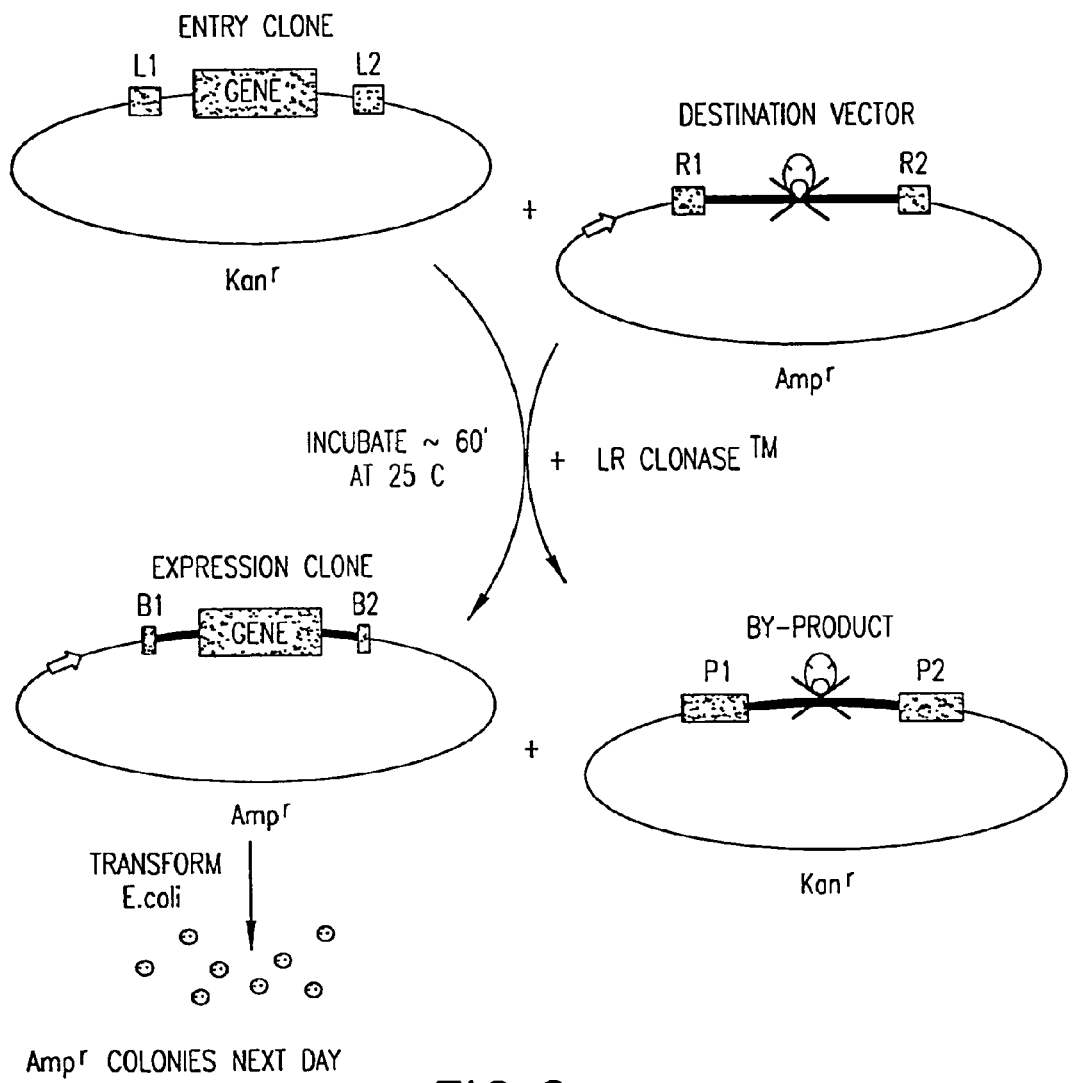
FIG. 2 is a more detailed depiction of the recombinational cloning system of the invention, referred to herein as the "GATEWAY™ Cloning System." This figure depicts the production of Expression Clones via a "Destination Reaction," which may also be referred to herein as an "LR Reaction." A kan$^r$ vector (referred to herein as an "Entry clone") containing a DNA molecule of interest (e.g., a gene) localized between an attL1 site and an attL2 site is reacted with an amp$^r$ vector (referred to herein as a "Destination Vector") containing a toxic or "death" gene localized between an attR1 site and an attR2 site, in the presence of GATEWAY™ LR Clonase™ Enzyme Mix (a mixture of Int, IHF and Xis). After incubation at 25° C. for about 60 minutes, the reaction yields an amp$^r$ Expression Clone containing the DNA molecule of interest localized between an attB1 site and an attB2 site, and a kan$^r$ byproduct molecule, as well as intermediates. The reaction mixture may then be transformed into host cells (e.g., *E. coli*) and clones containing the nucleic acid molecule of interest may be selected by plating the cells onto ampicillin-containing media and picking amp$^r$ colonies.

Two reactions constitute the recombinational cloning system of the present invention, referred to herein as the "GATEWAY™ Cloning System," as depicted generally in FIG. 1. The first of these reactions, the LR Reaction (FIG. 2), which may also be referred to interchangeably herein as the Destination Reaction, is the main pathway of this system. The LR Reaction is a recombination reaction between an Entry vector or clone and a Destination Vector, mediated by a cocktail of recombination proteins such as the GATEWAY™ LR Clonase™ Enzyme Mix described herein. This reaction transfers nucleic acid molecules of interest (which may be genes, cDNAs, cDNA libraries, or fragments thereof) from the Entry Clone to an Expression Vector, to create an Expression Clone.

The sites labeled L, R, B, and P are respectively the attL, attR, attB, and attP recombination sites for the bacteriophage λ recombination proteins that constitute the Clonase cocktail (referred to herein variously as "Clonase" or "GATEWAY™ LR Clonase™ Enzyme Mix" (for recombination protein mixtures mediating attB x attP recombination reactions, as described herein) or "GATEWAY™ BP Clonase™ Enzyme Mix" (for recombination protein mixtures mediating attB x attP recombination reactions, as described herein)). The Recombinational Cloning reactions are equivalent to concerted, highly specific, cutting and ligation reactions. Viewed in this way, the recombination proteins cut to the left and right of the nucleic acid molecule of interest in the Entry Clone and ligate it into the Destination vector, creating a new Expression Clone.

The nucleic acid molecule of interest in an Expression Clone is flanked by the small attB1 and attB2 sites. The orientation and reading frame of the nucleic acid molecule of interest are maintained throughout the subcloning, because attL1 reacts only with attR1, and attL2 reacts only with attR2. Likewise, attB1 reacts only with attP1, and attB2 reacts only with attP2. Thus, the invention also relates to methods of controlled or directional cloning using the recombination sites of the invention (or portions thereof), including variants, fragments, mutants and derivatives thereof which may have altered or enhanced specificity. The invention also relates more generally to any number of recombination site partners or pairs (where each recombination site is specific for and interacts with its corresponding recombination site). Such recombination sites are preferably made by mutating or modifying the recombination site to provide any number of necessary specificities (e.g., attB1-10, attP1-10, attL1-10, attR1-10, etc.), non-limiting examples of which are described in detail in the Examples herein.

When an aliquot from the recombination reaction is transformed into host cells (e.g., *E. coli*) and spread on plates containing an appropriate selection agent, e.g., an antibiotic such as ampicillin with or without methicillin, cells that take up the desired clone form colonies. The unreacted Destination Vector does not give ampicillin-resistant colonies, even though it carries the ampicillin-resistance gene, because it contains a toxic gene, e.g., ccdB. Thus selection for ampicillin resistance selects for *E. coli* cells that carry the desired product, which usually comprise >90% of the colonies on the ampicillin plate.

To participate in the Recombinational (or "GATEWAY™") Cloning Reaction, a nucleic acid molecule of interest first may be cloned into an Entry Vector, creating an Entry Clone. Multiple options are available for creating Entry Clones, including: cloning of PCR sequences with terminal attB recombination sites into Entry Vectors; using the GATEWAY™ Cloning System recombination reaction; transfer of genes from libraries prepared in GATEWAY™ Cloning System vectors by recombination into Entry Vectors; and cloning of restriction enzyme-generated fragments and PCR fragments into Entry Vectors by standard recombinant DNA methods. These approaches are discussed in further detail herein.

Figure 3:
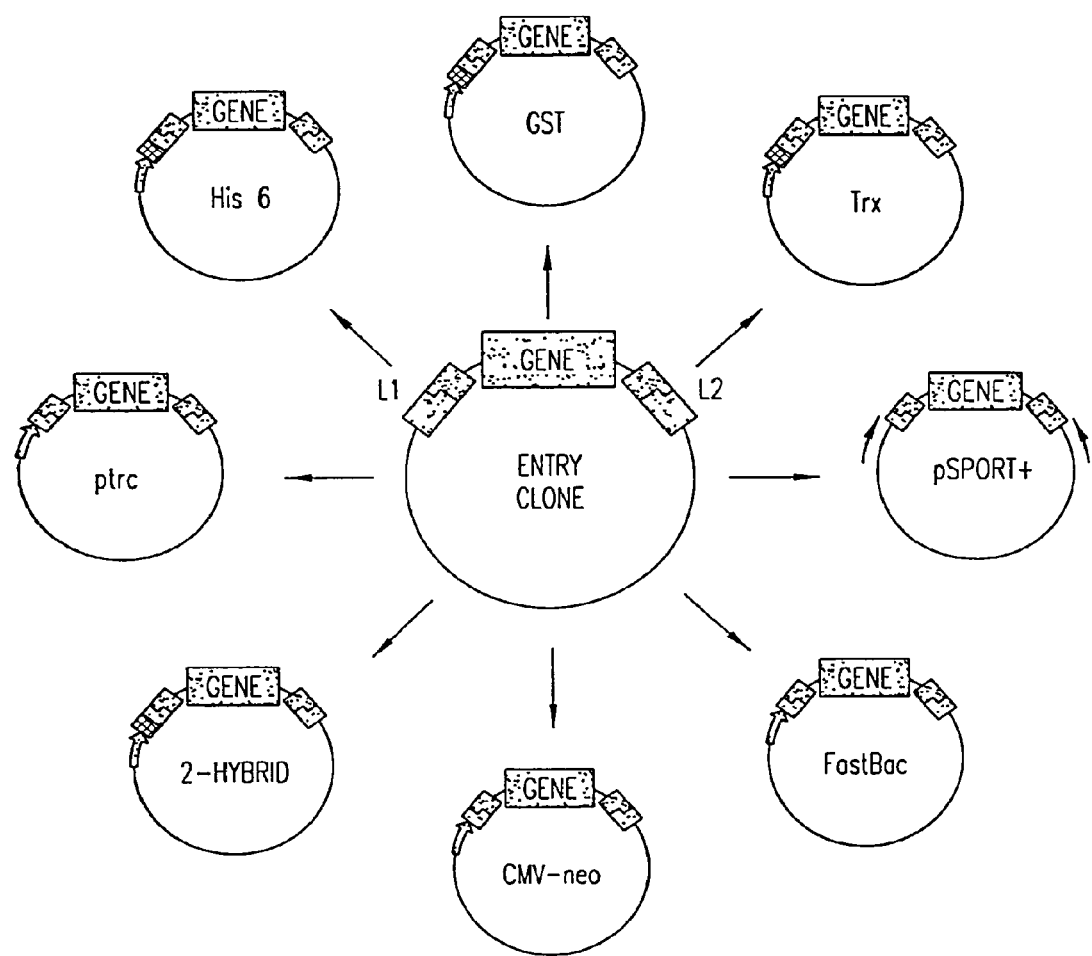
FIG. 3 is a schematic depiction of the cloning of a nucleic acid molecule from an Entry clone into multiple types of Destination vectors, to produce a variety of Expression Clones. Recombination between a given Entry clone and different types of Destination vectors (not shown), via the LR Reaction depicted in FIG. 2, produces multiple different Expression Clones for use in a variety of applications and host cell types.

A key advantage of the GATEWAY™ Cloning System is that a nucleic acid molecule of interest (or even a population of nucleic acid molecules of interest) present as an Entry Clone can be subcloned in parallel into one or more Destination Vectors in a simple reactions for anywhere from about 30 seconds to about 60 minutes (preferably about 1-60 minutes, about 1-45 minutes, about 1-30 minutes, about 2-60 minutes, about 2-45 minutes, about 2-30 minutes, about 1-2 minutes, about 30-60 minutes, about 45-60 minutes, or about 30-45 minutes). Longer reaction times (e.g., 2-24 hours, or overnight) may increase recombination efficiency, particularly where larger nucleic acid molecules are used, as described in the Examples herein. Moreover, a high percentage of the colonies obtained carry the desired Expression Clone. This process is illustrated schematically in FIG. 3, which shows an advantage of the invention in which the molecule of interest can be moved simultaneously or separately info multiple Destination Vectors. In the LR Reaction, one or both of the nucleic acid molecules to be recombined may have any topology (e.g., linear, relaxed circular, nicked circular, supercoiled, etc.), although one or both are preferably linear.

Figure 4:
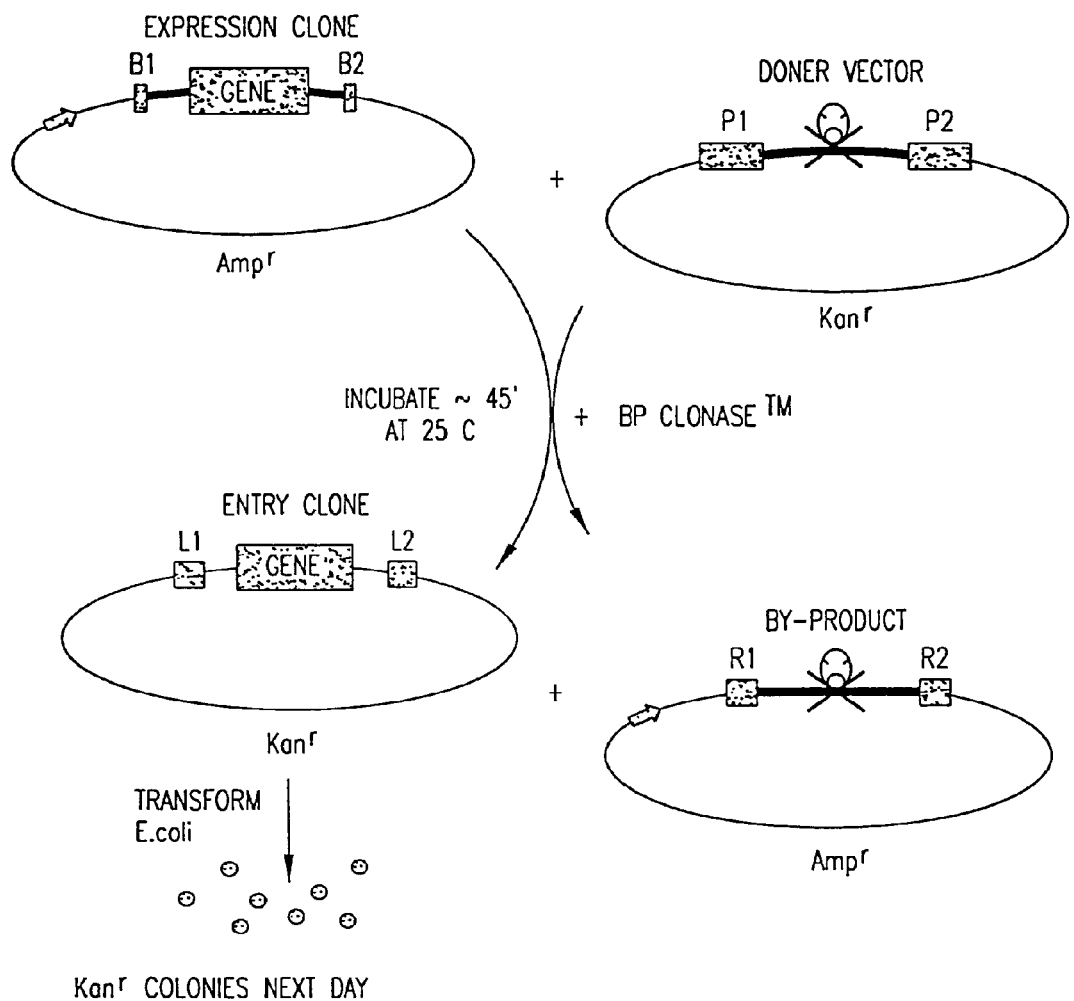
FIG. 4 is a detailed depiction of the production of Entry Clones via a "BP reaction," also referred to herein as an "Entry Reaction" or a "Gateward Reaction." In the example shown in this figure, an amp$^r$ expression vector containing a DNA molecule of interest (e.g., a gene) localized between an attB1 site and an attB2 site is reacted with a kan$^r$ Donor vector (e.g., an attP vector; here, GATEWAY™ pDONR201 (see FIGS. 49A-C)) containing a toxic or "death" gene localized between an attP1 site and an attP2 site, in the presence of GATEWAY™ BP Clonase™ Enzyme Mix (a mixture of Int and IHF). After incubation at 25° C. for about 60 minutes, the reaction yields a kan$^r$ Entry clone containing the DNA molecule of interest localized between an attL1 site and an attL2 site, and an amp$^r$ by-product molecule. The Entry clone may then be transformed into host cells (e.g., *E. coli*) and clones containing the Entry clone (and therefore the nucleic acid molecule of interest) may be selected by plating the cells onto kanamycin-containing media and picking kan$^r$ colonies. Although this figure shows an example of use of a kan$^r$ Donor vector, it is also possible to use Donor vectors containing other selection markers, such as the gentamycin resistance or tetracycline resistance markers, as discussed herein.

The second major pathway of the GATEWAY™ Cloning System is the BP Reaction (FIG. 4), which may also be referred to interchangeably herein as the Entry Reaction or the Gateward Reaction. The BP Reaction may recombine an Expression Clone with a Donor Plasmid (the counterpart of the byproduct in FIG. 2). This reaction transfers the nucleic acid molecule of interest (which may have any of a variety of topologies, including linear, coiled, supercoiled, etc.) in the Expression Clone into an Entry Vector, to produce a new Entry Clone. Once this nucleic acid molecule of interest is cloned into an Entry Vector, it can be transferred into new Expression Vectors, through the LR Reaction as described above. In the BP Reaction, one or both of the nucleic acid molecules to be recombined may have any topology (e.g., linear, relaxed circular, nicked circular, supercoiled, etc.), although one or both are preferably linear.

A useful variation of the BP Reaction permits rapid cloning and expression of products of amplification (e.g., PCR) or nucleic acid synthesis. Amplification (e.g., PCR) products synthesized with primers containing terminal 25 bp attB sites serve as efficient substrates for the Gateward Cloning reaction. Such amplification products may be recombined with a Donor Vector to produce an Entry Clone (see FIG. 7). The result is an Entry Clone containing the amplification fragment. Such Entry Clones can then be recombined with Destination Vectors—through the LR Reaction—to yield Expression Clones of the PCR product.

Additional details of the LR Reaction are shown in FIG. 5A. The GATEWAY™ LR Clonase™ Enzyme Mix that mediates this reaction contains lambda recombination proteins Int (Integrase), Xis (Excisionase), and IHF (Integration Host Factor). In contrast, the GATEWAY™ BP Clonase™ Enzyme Mix, which mediates the BP Reaction (FIG. 5B), comprises Int and IHF alone.

The recombination (att) sites of each vector comprise two distinct segments, donated by the parental vectors. The staggered lines dividing the two portions of each att site, depicted in FIGS. 5A and 5B, represent the seven-base staggered cut produced by Int during the recombination reactions. This structure is seen in greater detail in FIG. 6, which displays the attB recombination sequences of an Expression Clone, generated by recombination between the attL1 and attL2 sites of an Entry Clone and the attR1 and attR2 sites of a Destination Vector.

The nucleic acid molecule of interest in the Expression Clone is flanked by attB sites: attB1 to the left (amino terminus) and attB2 to the right (carboxy terminus). The bases in attB1 to the left of the seven-base staggered cut produced by Int are derived from the Destination vector, and the bases to the right of the staggered cut are derived from the Entry Vector (see FIG. 6). Note that the sequence is displayed in triplets corresponding to an open reading frame. If the reading frame of the nucleic acid molecule of interest cloned in the Entry Vector is in phase with the reading frame shown for attB1, amino-terminal protein fusions can be made between the nucleic acid molecule of interest and any GATEWAY™ Cloning System Destination Vector encoding an amino-terminal fusion domain. Entry Vectors and Destination Vectors that enable cloning in all three reading frames are described in more detail herein, particularly in the Examples.

Figure 7:
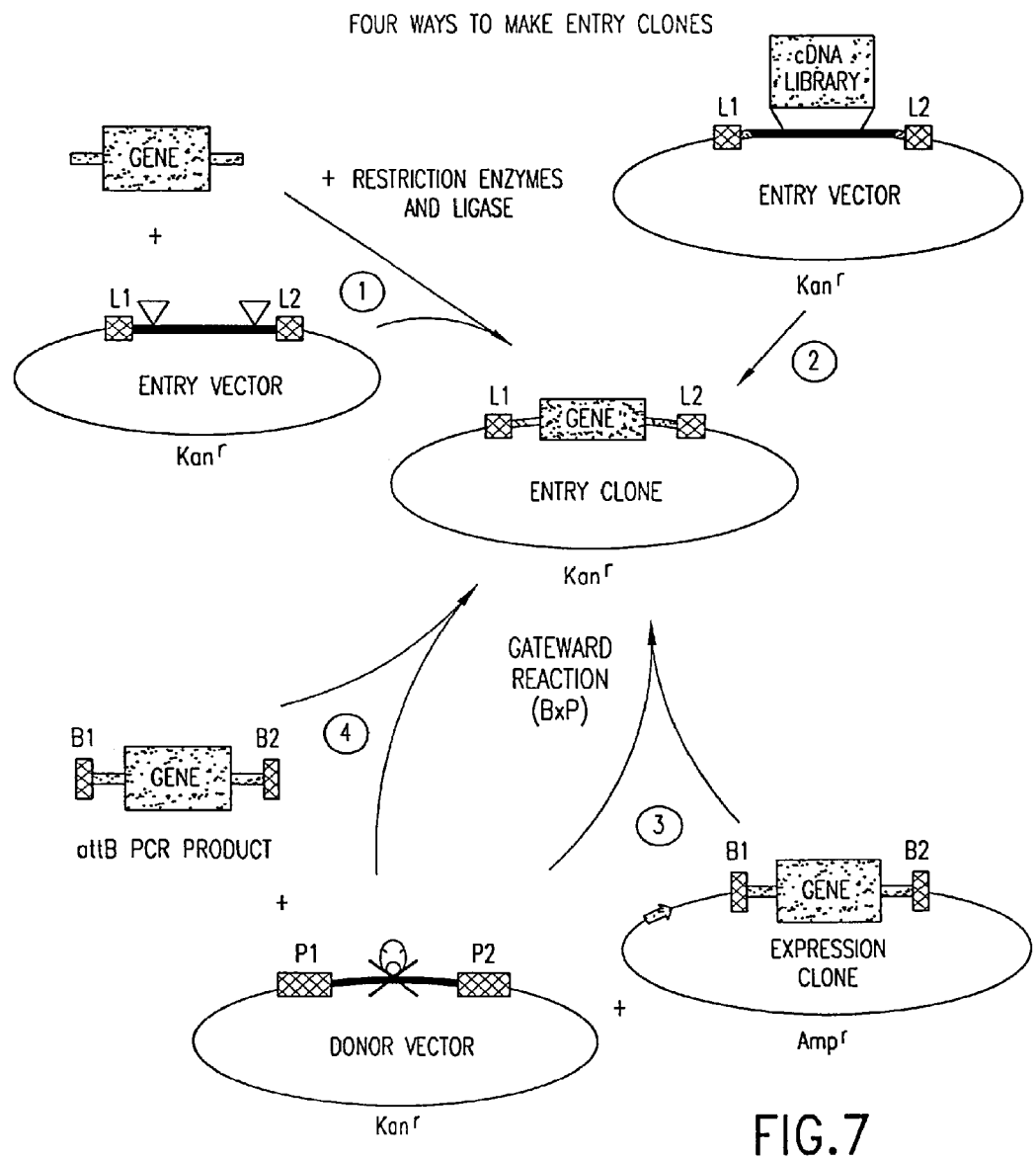

The LR Reaction allows the transfer of a desired nucleic acid molecule of interest into new Expression Vectors by recombining a Entry Clone with various Destination Vectors. To participate in the LR or Destination Reaction, however, a nucleic acid molecule of interest preferably is first converted to a Entry Clone. Entry Clones can be made in a number of ways, as shown in FIG. 7.

One approach is to clone the nucleic acid molecule of interest into one or more of the Entry Vectors, using standard recombinant DNA methods, with restriction enzymes and ligase. The starting DNA fragment can be generated by restriction enzyme digestion or as a PCR product. The fragment is cloned between the attL1 and attL2 recombination sites in the Entry Vector. Note that a toxic or "death" gene (e.g., ccdB), provided to minimize background colonies from incompletely digested Entry Vector, must be excised and replaced by the nucleic acid molecule of interest.

A second approach to making an Entry Clone (FIG. 7) is to make a library (genomic or cDNA) in an Entry Vector, as described in detail herein. Such libraries may then be transferred into Destination Vectors for expression screening, for example in appropriate host cells such as yeast cells or mammalian cells.

Figure 48A:
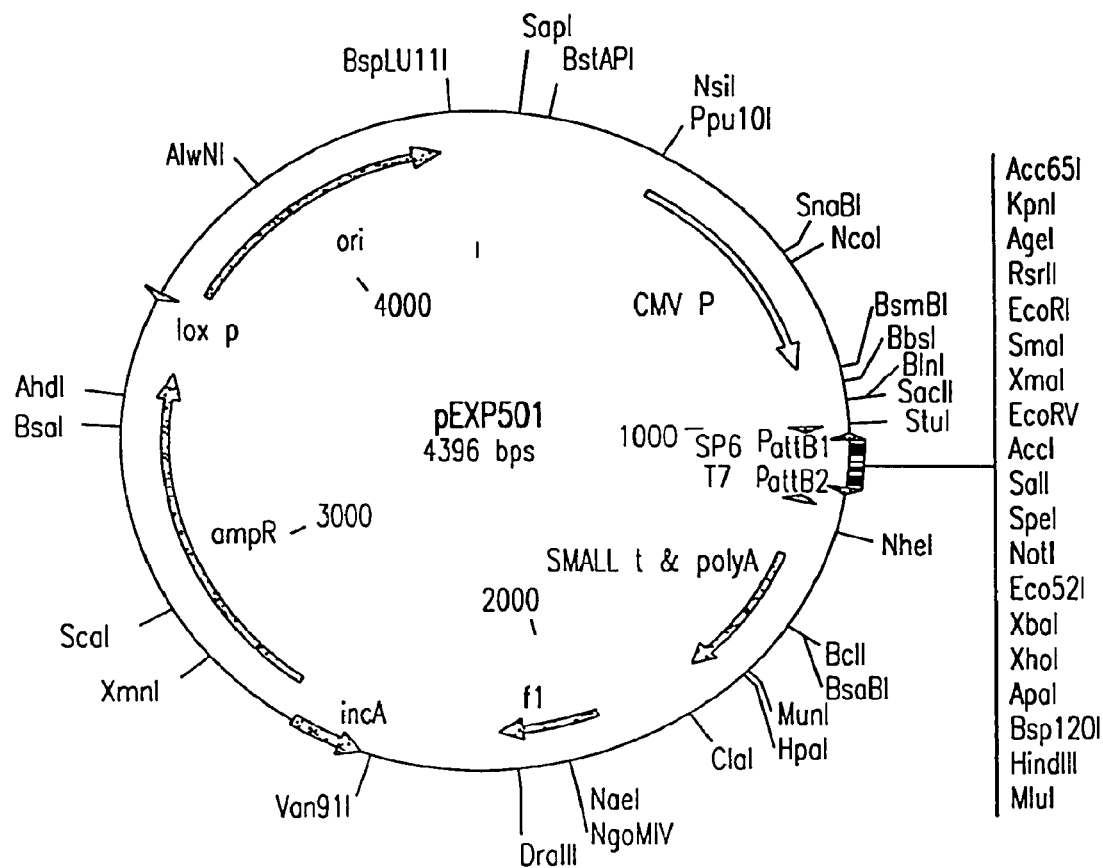
FIG. 48 is a depiction of the physical map (FIG. 48A) (SEQ ID NO: 283), the cloning sites (FIG. 48B), and the nucleotide sequence (FIGS. 48C-D) (SEQ ID NO:156), for the attB cloning vector plasmid pEXP501. This vector may also be referred to equivalently herein as pCMV•SPORT6, pCMVSPORT6, and pCMVSport6.

A third approach to making Entry Clones (FIG. 7) is to use Expression Clones obtained from cDNA molecules or libraries prepared in Expression Vectors. Such cDNAs or libraries, flanked by attB sites, can be introduced into a Entry Vector by recombination with a Donor Vector via the BP Reaction. If desired, an entire Expression Clone library can be transferred into the Entry Vector through the BP Reaction. Expression Clone cDNA libraries may also be constructed in a variety of prokaryotic and eukaryotic GATEWAY™-modified vectors (e.g., the pEXP501 Expression Vector (see FIG. 48), and 2-hybrid and attB library vectors), as described in detail herein, particularly in the Examples below.

Figure 8:
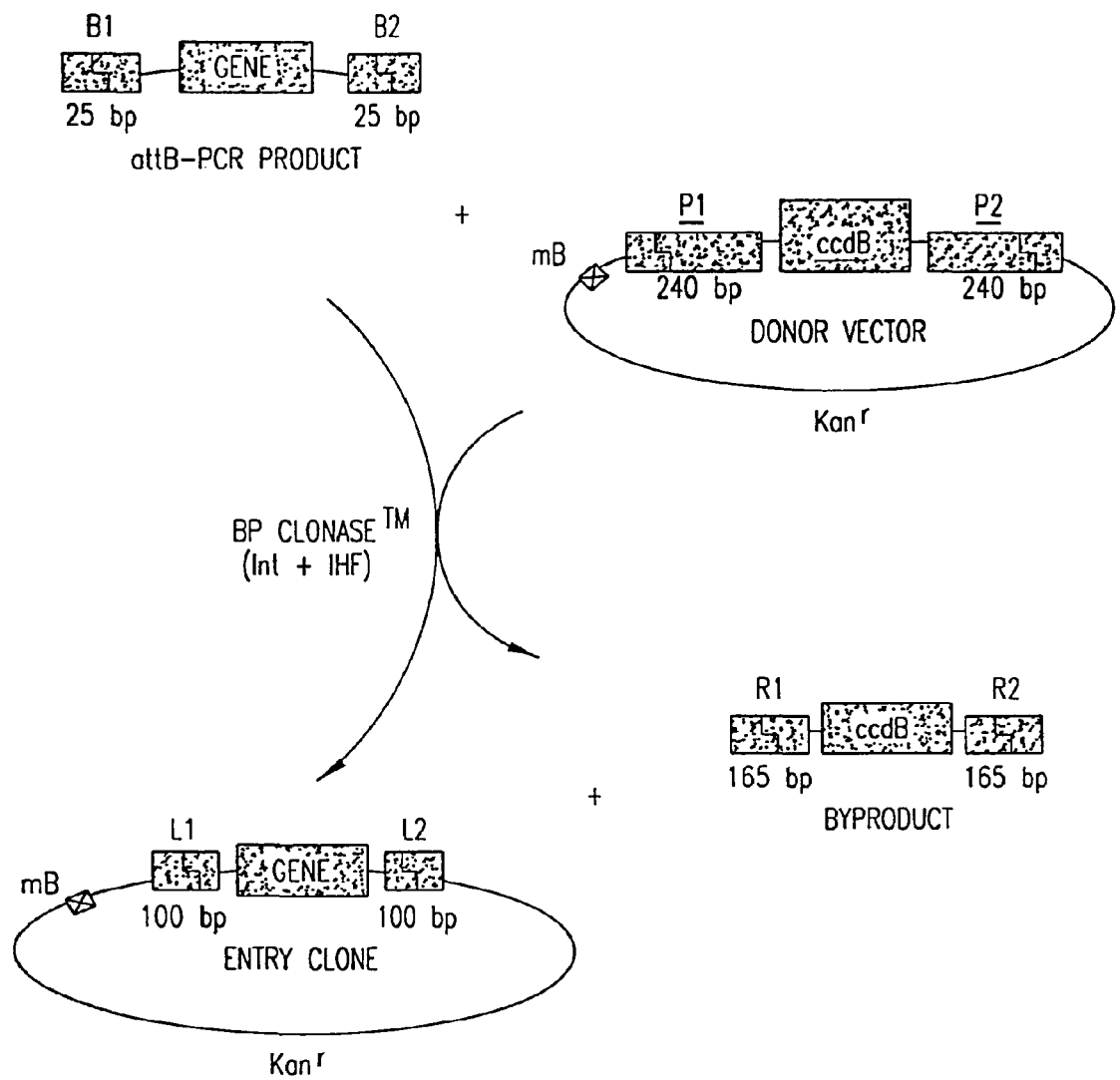
FIG. 8 is a schematic depiction of cloning of a PCR product by a B×P (Entry or Gateward) reaction. A PCR product with 25 bp terminal attB sites (plus four Gs) is shown as a substrate for the B×P reaction. Recombination between the attB-PCR product of a gene and a Donor vector (which donates an Entry Vector that carries kan$^r$) results in an Entry Clone of the PCR product.
Figure 10A:
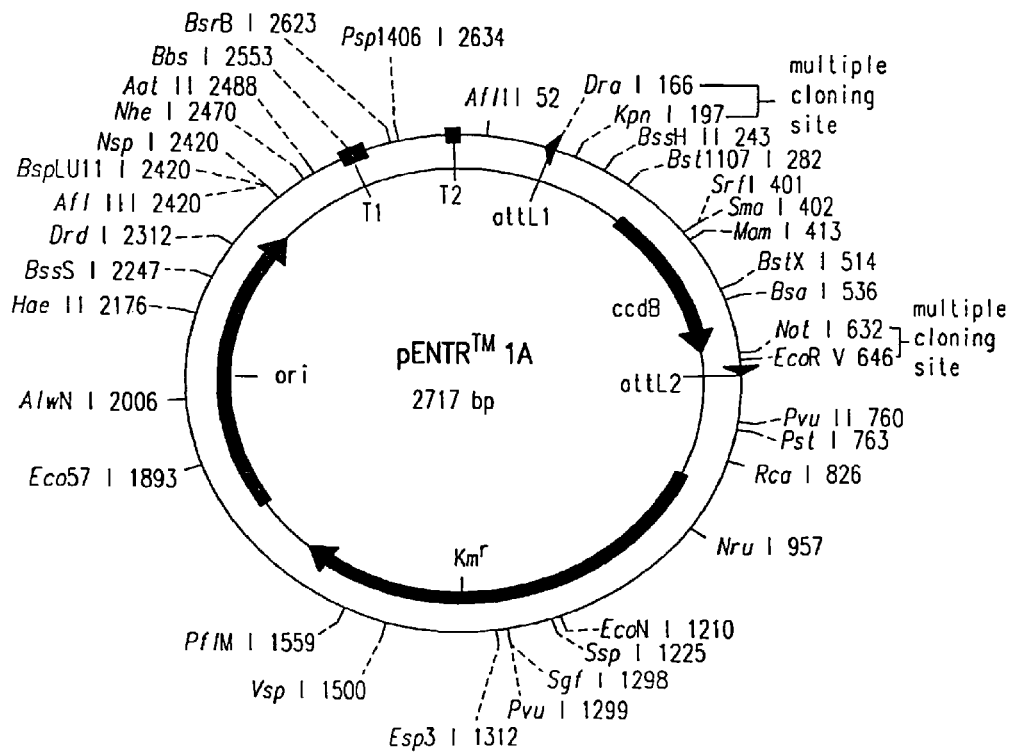
Figure 17A:
Figure 21A:
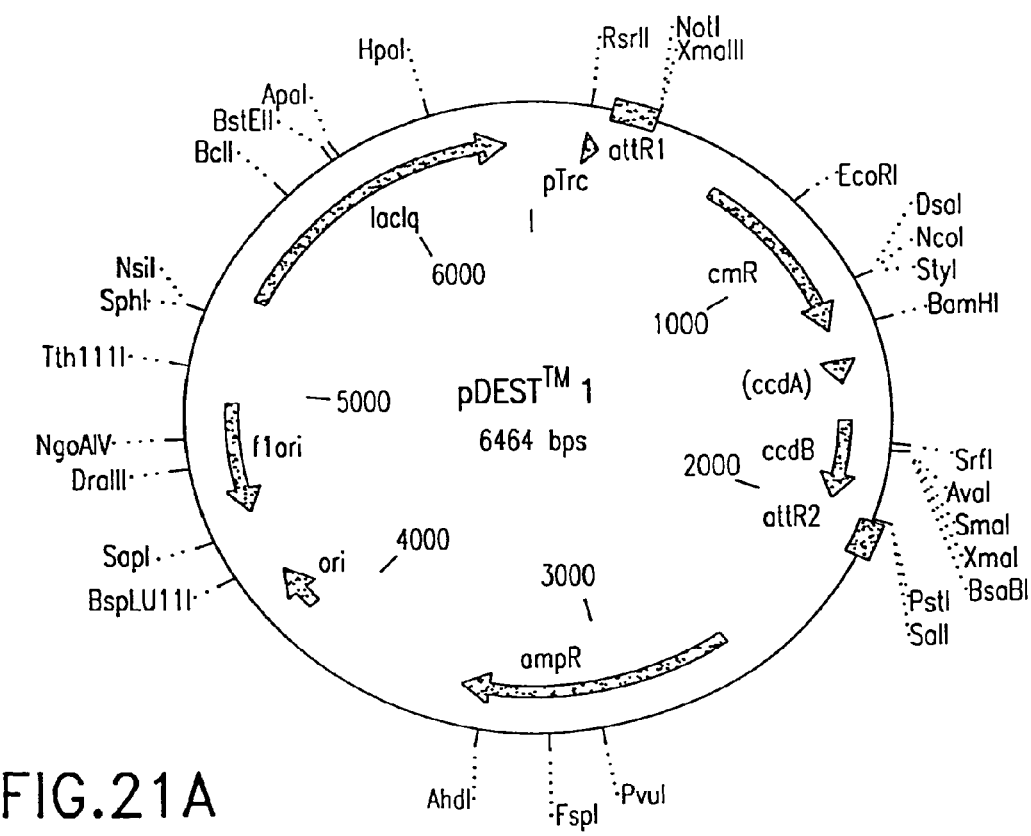
FIG. 21 is a schematic depiction of the physical map and the Trc expression cassette (FIG. 21A) (SEQ ID NO: 222) showing the promoter sequences at −35 and at −10 from the initiation codon, and the nucleotide sequence (FIGS. 21B-D) (SEQ ID NO:129), of Destination Vector pDEST1. This vector may also be referred to as pTrc-DEST1.
Figure 22A:
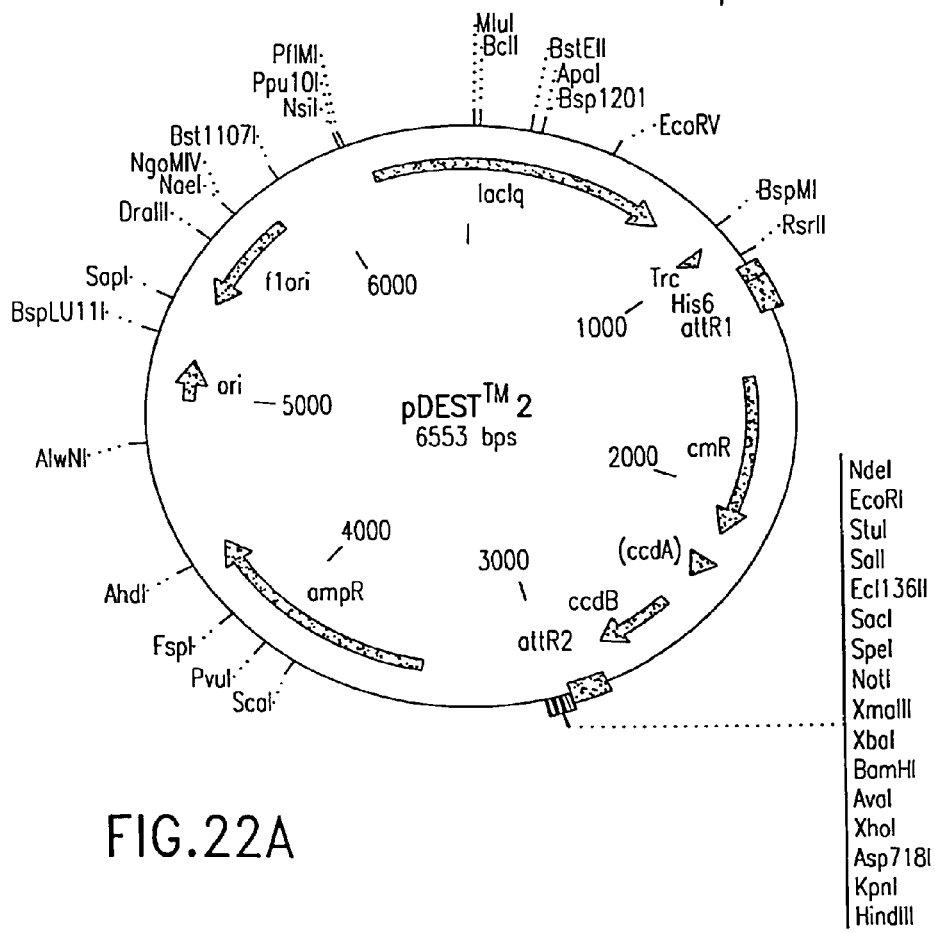
FIG. 22 is a schematic depiction of the physical map and the His6 expression cassette (FIG. 22A) (SEQ ID NOS 223-224, respectively, in order of appearance) showing the promoter sequences at −35 and at −10 from the initiation codon, and the nucleotide sequence (FIGS. 22B-D) (SEQ ID NO:130), of Destination Vector pDEST2. This vector may also be referred to as pHis6-DEST2.
Figure 23A:
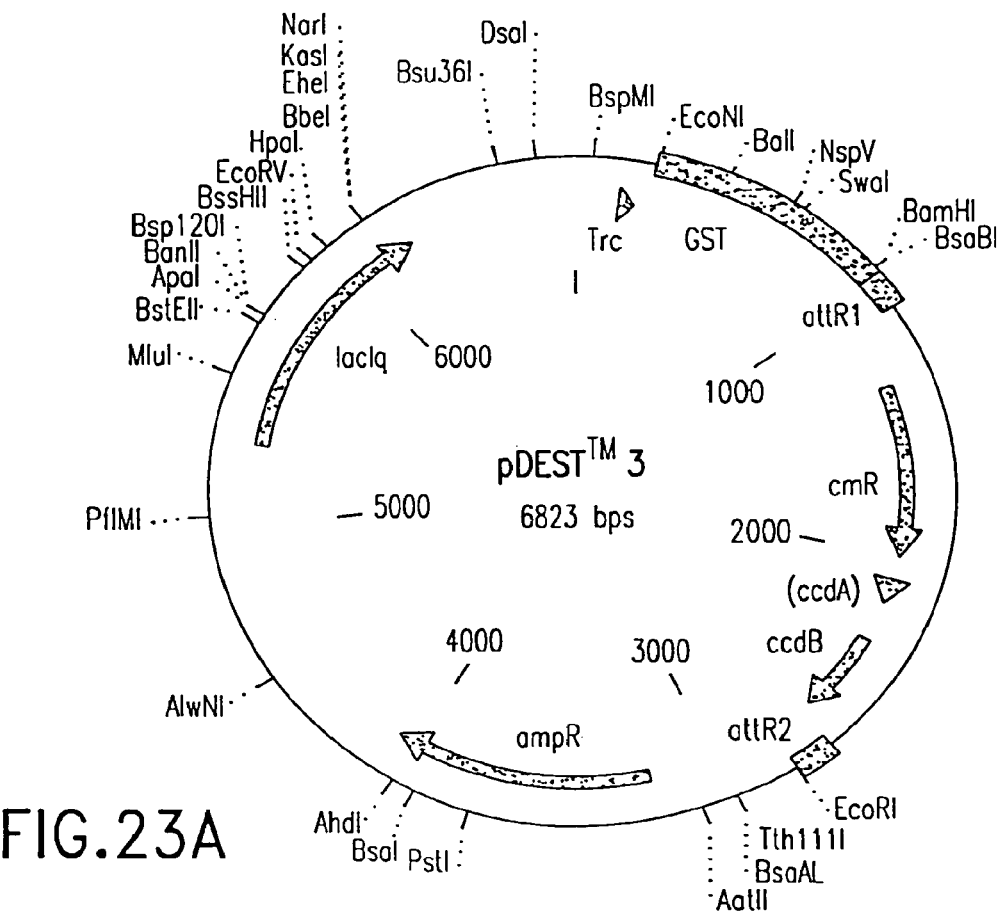
FIG. 23 is a schematic depiction of the physical map and the GST expression cassette (FIG. 23A) (SEQ ID NOS 225-226, 228 and 227, respectively, in order of appearance) showing the promoter sequences at −35 and at −10 from the initiation codon, and the nucleotide sequence (FIGS. 23B-D) (SEQ ID NO:131), of Destination Vector pDEST3. This vector may also be referred to as pGST-DEST3.
Figure 25B:
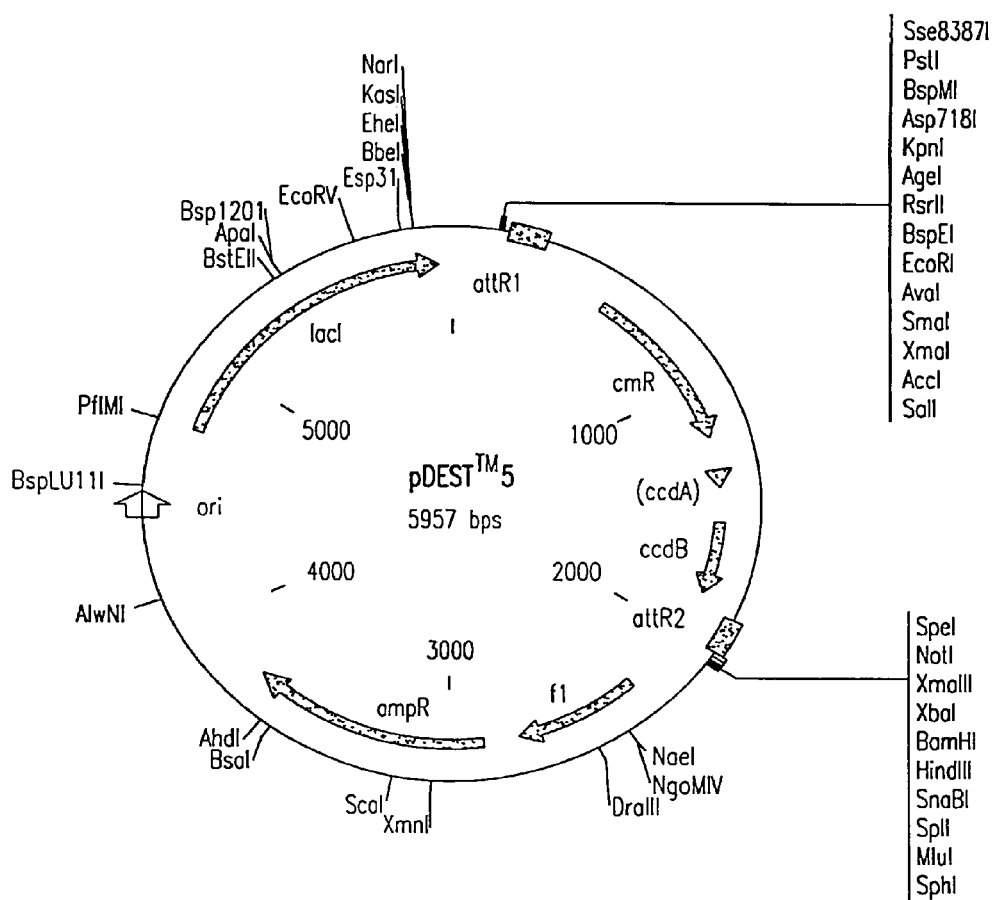
FIG. 25 is a schematic depiction of the attR1 and attR2 sites (FIG. 25A) (SEQ ID NOS 231-232, respectively, in order of appearance), the physical map (FIG. 25B), and the nucleotide sequence (FIGS. 25C-D) (SEQ ID NO:133) of Destination Vector pDEST5. This vector may also be referred to as pSPORT(+)-DEST5.

A fourth, and potentially most versatile, approach to making an Entry Clone (FIG. 7) is to introduce a sequence for a nucleic acid molecule of interest into an Entry Vector by amplification (e.g., PCR) fragment cloning. This method is diagramed in FIG. 8. The DNA sequence first is amplified (for example, with PCR) as outlined in detail below and in the Examples herein, using primers containing one or more bp, two or more bp, three or more bp, four or more bp, five or more bp, preferably six or more bp, more preferably 6-25 bp (particularly 12, 13, 14, 15, 16, 17, 18, 19, 20, 21, 22, 23, 24 or 25) bp of the attB nucleotide sequences (such as, but not limited to, those depicted in FIG. 9), and optionally one or more, two or more, three or more, four or more, and most preferably four or five or more additional terminal nucleotide bases which preferably are guanines. The PCR product then may be converted to a Entry Clone by performing a BP Reaction, in which the attB-PCR product recombines with a Donor Vector containing one or more attP sites. Details of this approach and protocols for PCR fragment subcloning are provided in Examples 8 and 21-25.

A variety of Entry Clones may be produced by these methods, providing a wide array of cloning options; a number of specific Entry Vectors are also available commercially from Life Technologies, Inc. (Rockville, Md.). The Examples herein provide a more in-depth description of selected Entry Vectors and details of their cloning sites. Choosing the optimal Entry Vector for a particular application is discussed in Example 4.

Entry Vectors and Destination Vectors should be constructed so that the amino-terminal region of a nucleic acid molecule of interest (e.g., a gene, cDNA library or insert, or fragment thereof) will be positioned next to the attL1 site. Entry Vectors preferably contain the rrnB transcriptional terminator upstream of the attL1 site. This sequence ensures that expression of cloned nucleic acid molecules of interest is reliably "off" in E. coli, so that even toxic genes can be successfully cloned. Thus, Entry Clones may be designed to be transcriptionally silent. Note also that Entry Vectors, and hence Entry Clones, may contain the kanamycin antibiotic resistance ($kan^r$) gene to facilitate selection of host cells containing Entry Clones after transformation. In certain applications, however, Entry Clones may contain other selection markers, including but not limited to a gentamycin resistance ($gen^r$) or tetracycline resistance ($tet^r$) gene, to facilitate selection of host cells containing Entry Clones after transformation.

Once a nucleic acid molecule of interest has been cloned into an Entry Vector, it may be moved into a Destination Vector. The upper right portion of FIG. 5A shows a schematic of a Destination Vector. The thick arrow represents some function (often transcription or translation) that will act on the nucleic acid molecule of interest in the clone. During the recombination reaction, the region between the attR1 and attR2 sites, including a toxic or "death" gene (e.g., ccdB), is replaced by the DNA segment from the Entry Clone. Selection for recombinants that have acquired the ampicillin resistance ($amp^r$) gene (carried on the Destination Vector) and that have also lost the death gene ensures that a high percentage (usually >90%) of the resulting colonies will contain the correct insert.

To move a nucleic acid molecule of interest into a Destination Vector, the Destination Vector is mixed with the Entry Clone comprising the desired nucleic acid molecule of interest, a cocktail of recombination proteins (e.g., GATEWAY™ LR Clonase™ Enzyme Mix) is added, the mixture is incubated (preferably at about 25° C. for about 60 minutes, or longer under certain circumstances, e.g. for transfer of large nucleic acid molecules, as described below) and any standard host cell (including bacterial cells such as E. coli; animal cells such as insect cells, mammalian cells, nematode cells and the like; plant cells; and yeast cells) strain is transformed with the reaction mixture. The host cell used will be determined by the desired selection (e.g., E. coli DB3.1, available commercially from Life Technologies, Inc., allows survival of clones containing the ccdB death gene, and thus can be used to select for cointegrate molecules—i.e., molecules that are hybrids between the Entry Clone and Destination Vector). The Examples below provide further details and protocols for use of Entry and Destination Vectors in transferring nucleic acid molecules of interest and expressing RNAs or polypeptides encoded by these nucleic acid molecules in a variety of host cells.

The cloning system of the invention therefore offers multiple advantages:

- Once a nucleic acid molecule of interest is cloned into the GATEWAY™ Cloning System, it can be moved into and out of other vectors with complete fidelity of reading frame and orientation. That is, since the reactions proceed whereby attL1 on the Entry Clone recombines with attR1 on the Destination Vector, the directionality of the nucleic acid molecule of interest is maintained or may be controlled upon transfer from the Entry Clone into the Destination Vector. Hence, the GATEWAY™ Cloning System provides a powerful and easy method of directional cloning of nucleic acid molecule of interest.
- One-step cloning or subcloning: Mix the Entry Clone and the Destination Vector with Clonase, incubate, and transform.
- Clone PCR products readily by in vitro recombination, by adding attB sites to PCR primers. Then directly transfer these Entry Clones into Destination Vectors. This process may also be carried out in one step (see Examples below).
- Powerful selections give high reliability: >90% (and often >99%) of the colonies contain the desired DNA in its new vector.
- One-step conversion of existing standard vectors into GATEWAY™ Cloning System vectors.
- Ideal for large vectors or those with few cloning sites.
- Recombination sites are short (25 bp), and may be engineered to contain no stop codons or secondary structures.
- Reactions may be automated, for high-throughput applications (e.g., for diagnostic purposes or for therapeutic candidate screening).
- The reactions are economical: 0.3 µg of each DNA; no restriction enzymes, phosphatase, ligase, or gel purification. Reactions work well with miniprep DNA.
- Transfer multiple clones, and even libraries, into one or more Destination Vectors, in a single experiment.
- A variety of Destination Vectors may be produced, for applications including, but not limited to:
  - Protein expression in E. coli: native proteins; fusion proteins with GST, His6, thioredoxin, etc., for purification, or one or more epitope tags; any promoter useful in expressing proteins in *E. coli* may be used, such as ptrc, $\lambda P_L$, and T7 promoters.

Protein expression in eukaryotic cells: CMV promoter, baculovirus (with or without His6 tag), Semliki Forest virus, Tet regulation.

DNA sequencing (all lac primers), RNA probes, phagemids (both strands)

A variety of Entry Vectors (for recombinational cloning entry by standard recombinant DNA methods) may be produced:

Strong transcription stop just upstream, for genes toxic to *E. coli*.

Three reading frames.

With or without TEV protease cleavage site.

Motifs for prokaryotic and/or eukaryotic translation.

Compatible with commercial cDNA libraries.

Expression Clone cDNA (attB) libraries, for expression screening, including 2-hybrid libraries and phage display libraries, may also be constructed.

Recombination Site Sequences

In one aspect, the invention relates to nucleic acid molecules, which may or may not be isolated nucleic acid molecules, comprising one or more nucleotide sequences encoding one or more recombination sites or portions thereof. In particular, this aspect of the invention relates to such nucleic acid molecules comprising one or more nucleotide sequences encoding attB, attP, attL, or attR, or portions of these recombination site sequences. The invention also relates to mutants, derivatives, and fragments of such nucleic acid molecules. Unless otherwise indicated, all nucleotide sequences that may have been determined by sequencing a DNA molecule herein were determined using manual or automated DNA sequencing, such as dideoxy sequencing, according to methods that are routine to one of ordinary skill in the art (Sanger, F., and Coulson, A. R., *J. Mol. Biol.* 94:444-448 (1975); Sanger, F., et al., *Proc. Natl. Acad. Sci. USA* 74:5463-5467 (1977)). All amino acid sequences of polypeptides encoded by DNA molecules determined herein were predicted by conceptual translation of a DNA sequence determined as above. Therefore, as is known in the art for any DNA sequence determined by these approaches, any nucleotide sequence determined herein may contain some errors. Nucleotide sequences determined by such methods are typically at least about 90% identical, more typically at least about 95% to at least about 99.9% identical to the actual nucleotide sequence of the sequenced DNA molecule. As is also known in the art, a single insertion or deletion in a determined nucleotide sequence compared to the actual sequence will cause a frame shift in translation of the nucleotide sequence such that the predicted amino acid sequence encoded by a determined nucleotide sequence will be completely different from the amino acid sequence actually encoded by the sequenced DNA molecule, beginning at the point of such an insertion or deletion.

Unless otherwise indicated, each "nucleotide sequence" set forth herein is presented as a sequence of deoxyribonucleotides (abbreviated A, G, C and T). However, by "nucleotide sequence" of a nucleic acid molecule or polynucleotide is intended, for a DNA molecule or polynucleotide, a sequence of deoxyribonucleotides, and for an RNA molecule or polynucleotide, the corresponding sequence of ribonucleotides (A, G, C and U), where each thymidine deoxyribonucleotide (T) in the specified deoxyribonucleotide sequence is replaced by the ribonucleotide uridine (U). Thus, the invention relates to sequences of the invention in the form of DNA or RNA molecules, or hybrid DNA/RNA molecules, and their corresponding complementary DNA, RNA, or DNA/RNA strands.

In a first such aspect, the invention provides nucleic acid molecules comprising one or more nucleotide sequences encoding attB1, or mutants, fragments, variants or derivatives thereof. Such nucleic acid molecules may comprise an attB1 nucleotide sequence having the sequence set forth in FIG. 9, such as: ACAAGTTTGTACAAAAAAGCAGGCT (SEQ ID NO:1), or a nucleotide sequence complementary to the nucleotide sequence set forth in FIG. 9 for attB1, or mutants, fragments, variants or derivatives thereof. As one of ordinary skill will appreciate, however, certain mutations, insertions, or deletions of one or more bases in the attB1 sequence contained in the nucleic acid molecules of the invention may be made without compromising the structural and functional integrity of these molecules; hence, nucleic acid molecules comprising such mutations, insertions, or deletions in the attB1 sequence are encompassed within the scope of the invention.

In a related aspect, the invention provides nucleic acid molecules comprising one or more nucleotide sequences encoding attB2, or mutants, fragments, variants or derivatives thereof. Such nucleic acid molecules may comprise an attB2 nucleotide sequence having the sequence set forth in FIG. 9, such as: ACCCAGCTTTCTTGTACAAAGTGGT (SEQ ID NO:2), or a nucleotide sequence complementary to the nucleotide sequence set forth in FIG. 9 for attB2, or mutants, fragments, variants or derivatives thereof. As noted above for attB1, certain mutations, insertions, or deletions of one or more bases in the attB2 sequence contained in the nucleic acid molecules of the invention may be made without compromising the structural and functional integrity of these molecules; hence, nucleic acid molecules comprising such mutations, insertions, or deletions in the attB2 sequence are encompassed within the scope of the invention.

A recombinant host cell comprising a nucleic acid molecule containing attB1 and attB2 sites (the vector pEXP501, also known as pCMVSport6; see FIG. 48), *E. coli* DB3.1 (pCMVSport6), was deposited on Feb. 27, 1999, with the Collection, Agricultural Research Culture Collection (NRRL), 1815 North University Street, Peoria, Ill. 61604 USA, as Deposit No. NRRL B-30108. The attB1 and attB2 sites within the deposited nucleic acid molecule are contained in nucleic acid cassettes in association with one or more additional functional sequences as described in more detail below.

In another related aspect, the invention provides nucleic acid molecules comprising one or more nucleotide sequences encoding attP1, or mutants, fragments, variants or derivatives thereof. Such nucleic acid molecules may comprise an attP1 nucleotide sequence having the sequence set forth in FIG. 9, such as: TACAGGTCACTAATACCATCTAAGTAGT-TGATTCATAGTGA-CTGGATATGTTGTGTTTTACAG-TATTATGTAGTCTGTTTTTTAT-GCAAAATCTAATT-TAATATATTGATATTTATATCATTTTACGTT-TCTCGTTCAGCTTTTTTGTACAAAGTTGGCATTAT-AAAAAAGCATTG-CTCATCAATTTGTTGCAACGAA-CAGGTCACTATCAGTCAAAATAA-AATCATTATTTG (SEQ ID NO:3), or a nucleotide sequence complementary to the nucleotide sequence set forth in FIG. 9 for attP1, or mutants, fragments, variants or derivatives thereof. As noted above for attB1, certain mutations, insertions, or deletions of one or more bases in the attP1 sequence contained in the nucleic acid molecules of the invention may be made without compromising the structural and functional integrity of these molecules; hence, nucleic acid molecules comprising such mutations, insertions, or deletions in the attP1 sequence are encompassed within the scope of the invention.

In another related aspect, the invention provides nucleic acid molecules comprising one or more nucleotide sequences encoding attP2, or mutants, fragments, variants or derivatives thereof. Such nucleic acid molecules may comprise an attP2 nucleotide sequence having the sequence set forth in FIG. 9, such as: CAAATAATGATTTTATTTTGACTGAT-AGTGACCTGTTCGTTG-CAACAAATTGATAAGCAAT-GCTTTCTTATAATGCCAACTTT-GTACAAGAAAGCT-GAACGAGAAACGTAAAATGATA-TAAATATCAATATATTAAATTAGATTTTGCATAAAAA-ACAG-ACTACATAATACTGTAAAACACAA-CATATCCAGTCACTATGAATCAA-CTACTTAGATGG-TATTAGTGACCTGTA (SEQ ID NO:4), or a nucleotide sequence complementary to the nucleotide sequence set forth in FIG. 9 for attP2, or mutants, fragments, variants or derivatives thereof. As noted above for attB1, certain mutations, insertions, or deletions of one or more bases in the attP2 sequence contained in the nucleic acid molecules of the invention may be made without compromising the structural and functional integrity of these molecules; hence, nucleic acid molecules comprising such mutations, insertions, or deletions in the attP2 sequence are encompassed within the scope of the invention.

Figure 49A:
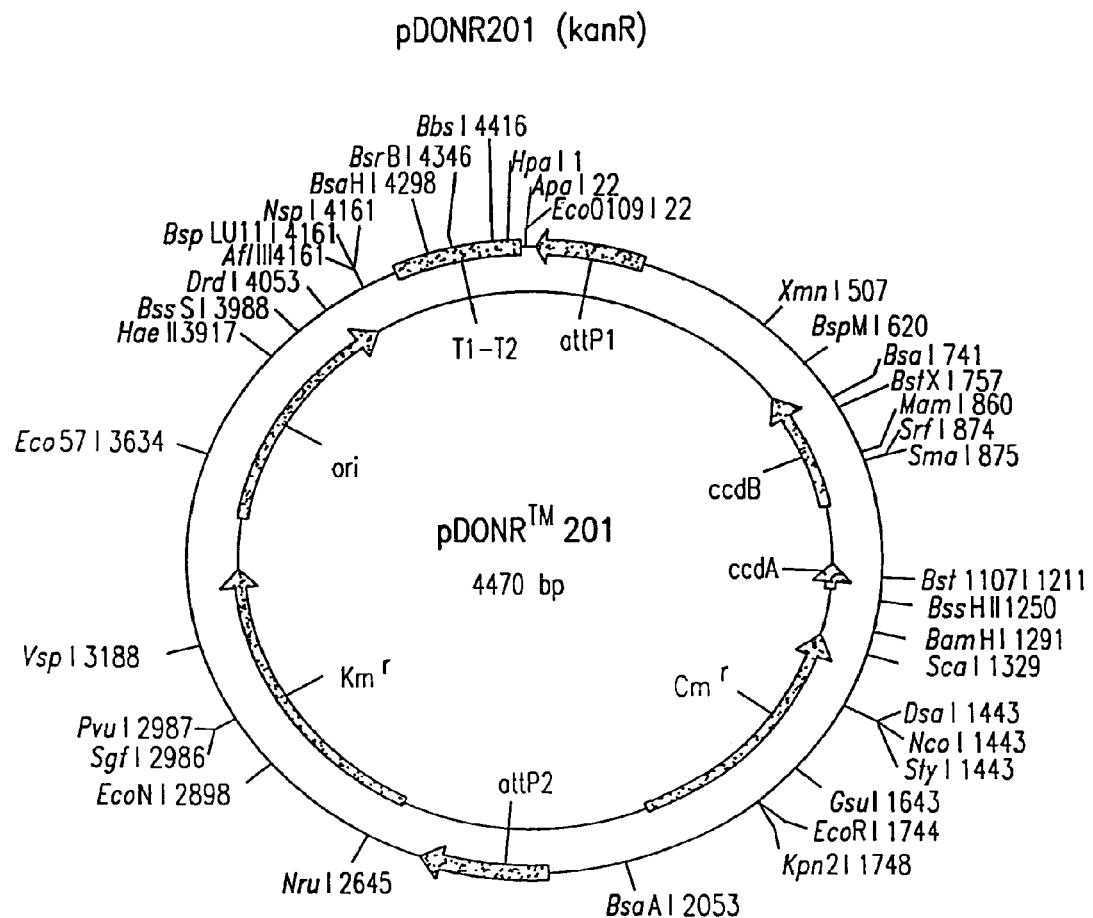
FIG. 49 is a depiction of the physical map (FIG. 49A), and the nucleotide sequence (FIGS. 49B-C) (SEQ ID NO:157), for the Donor plasmid pDONR201 which donates a kanamycin-resistant vector in the BP Reaction. This vector may also be referred to as pAttPkanr Donor Plasmid, or as pAttPkan Donor Plasmid

A recombinant host cell comprising a nucleic acid molecule (the attP vector pDONR201, also known as pENTR21-attPkan or pAttPkan; see FIG. 49) containing attP1 and attP2 sites, *E. coli* DB3.1 (pAttPkan) (also called *E. coli* DB3.1 (pAHKan)), was deposited on Feb. 27, 1999, with the Collection, Agricultural Research Culture Collection (NRRL), 1815 North University Street, Peoria, Ill. 61604 USA, as Deposit No. NRRL B-30099. The attP1 and attP2 sites within the deposited nucleic acid molecule are contained in nucleic acid cassettes in association with one or more additional functional sequences as described in more detail below.

In another related aspect, the invention provides nucleic acid molecules comprising one or more nucleotide sequences encoding attR1, or mutants, fragments, variants or derivatives thereof. Such nucleic acid molecules may comprise an attR1 nucleotide sequence having the sequence set forth in FIG. 9, such as: ACAAGTTTGTACAAAAAAGCTGAACGAG-AAACGTAAAATGATATAAATAT-CAATATATTAAATTAGATTTTGCAT-AAAAAACAGAC-TACATAATACTGTAAAACACAACATATCCAGTCA-CTATG (SEQ ID NO:5), or a nucleotide sequence complementary to the nucleotide sequence set forth in FIG. 9 for attR1, or mutants, fragments, variants or derivatives thereof. As noted above for attB1, certain mutations, insertions, or deletions of one or more bases in the attR1 sequence contained in the nucleic acid molecules of the invention may be made without compromising the structural and functional integrity of these molecules; hence, nucleic acid molecules comprising such mutations, insertions, or deletions in the attR1 sequence are encompassed within the scope of the invention.

In another related aspect, the invention provides nucleic acid molecules comprising one or more nucleotide sequences encoding attR2, or mutants, fragments, variants or derivatives thereof. Such nucleic acid molecules may comprise an attR2 nucleotide sequence having the sequence set forth in FIG. 9, such as: GCAGGTCGACCATAGTGACTGGATAT-GT-TGTGTTTTACAGTATTATGTAGTCT-GTTTTTTATGCAAAATCTA-ATTTAATATATTGATATT-TATATCATTTTACGTTTCTCGTTCAGCTT-TCTTGTACAAAGTGGT (SEQ ID NO:6), or a nucleotide sequence complementary to the nucleotide sequence set forth in FIG. 9 for attR2, or mutants, fragments, variants or derivatives thereof. As noted above for attB1, certain mutations, insertions, or deletions of one or more bases in the attR2 sequence contained in the nucleic acid molecules of the invention may be made without compromising the structural and functional integrity of these molecules; hence, nucleic acid molecules comprising such mutations, insertions, or deletions in the attR2 sequence are encompassed within the scope of the invention.

Recombinant host cell strains containing attR1 sites apposed to cloning sites in reading frame A, reading frame B, and reading frame C, *E. coli* DB3.1 (pEZC15101) (reading frame A; see FIG. 64A), *E. coli* DB3.1 (pEZC15102) (reading frame B; see FIG. 64B), and *E. coli* DB3.1 (pEZC15103) (reading frame C; see FIG. 64C), and containing corresponding attR2 sites, were deposited on Feb. 27, 1999, with the Collection, Agricultural Research Culture Collection (NRRL), 1815 North University Street, Peoria, Ill. 61604 USA, as Deposit Nos. NRRL B-30103, NRRL B-30104, and NRRL B-30105, respectively. The attR1 and attR2 sites within the deposited nucleic acid molecules are contained in nucleic acid cassettes in association with one or more additional functional sequences as described in more detail below.

In another related aspect, the invention provides nucleic acid molecules comprising one or more nucleotide sequences encoding attL1, or mutants, fragments, variants and derivatives thereof. Such nucleic acid molecules may comprise an attL1 nucleotide sequence having the sequence set forth in FIG. 9, such as: CAA ATA ATG ATT TTA TTT TGA CTG ATA GTG ACC TGT TCG TTG CAA CAA ATT GAT AAG CAA TGC TTT TTT ATA ATG CCA ACT TTG TAC AAA AAA GCA GGC T (SEQ ID NO:7), or a nucleotide sequence complementary to the nucleotide sequence set forth in FIG. 9 for attL1, or mutants, fragments, variants or derivatives thereof. As noted above for attB1, certain mutations, insertions, or deletions of one or more bases in the attL1 sequence contained in the nucleic acid molecules of the invention may be made without compromising the structural and functional integrity of these molecules; hence, nucleic acid molecules comprising such mutations, insertions, or deletions in the attL1 sequence are encompassed within the scope of the invention.

In another related aspect, the invention provides nucleic acid molecules comprising one or more nucleotide sequences encoding attL2, or mutants, fragments, variants and derivatives thereof. Such nucleic acid molecules may comprise an attL2 nucleotide sequence having the sequence set forth in FIG. 9, such as: C AAA TAA TGA TTT TAT TTT GAC TGA TAG TGA CCT GTT CGT TGC AAC AAA TTG ATA AGC AAT GCT TTC TTA TAA TGC CAA CTT TGT ACA AGA AAG CTG GGT (SEQ ID NO:8), or a nucleotide sequence complementary to the nucleotide sequence set forth in FIG. 9 for attL2, or mutants, fragments, variants or derivatives thereof. As noted above for attB1, certain mutations, insertions, or deletions of one or more bases in the attL2 sequence contained in the nucleic acid molecules of the invention may be made without compromising the structural and functional integrity of these molecules; hence, nucleic acid molecules comprising such mutations, insertions, or deletions in the attL2 sequence are encompassed within the scope of the invention.

Recombinant host cell strains containing attL1 sites apposed to cloning sites in reading frame A, reading frame B, and reading frame C, *E. coli* DB3.1 (pENTR1A) (reading frame A; see FIG. 10), *E. coli* DB3.1 (pENTR2B) (reading frame B; see FIG. 11), and *E. coli* DB3.1 (pENTR3C) (reading frame C; see FIG. 12), and containing corresponding attL2 sites, were deposited on Feb. 27, 1999, with the Collection, Agricultural Research Culture Collection (NRRL), 1815

North University Street, Peoria, Ill. 61604 USA, as Deposit Nos. NRRL B-30100, NRRL B-30101, and NRRL B-30102, respectively. The attL1 and attL2 sites within the deposited nucleic acid molecules are contained in nucleic acid cassettes in association with one or more additional functional sequences as described in more detail below.

Each of the recombination site sequences described herein or portions thereof, or the nucleotide sequence cassettes contained in the deposited clones, may be cloned or inserted into a vector of interest (for example, using the recombinational cloning methods described herein and/or standard restriction cloning techniques that are routine in the art) to generate, for example, Entry Vectors or Destination Vectors which may be used to transfer a desired segment of a nucleic acid molecule of interest (e.g., a gene, cDNA molecule, or cDNA library) into a desired vector or into a host cell.

Using the information provided herein, such as the nucleotide sequences for the recombination site sequences described herein, an isolated nucleic acid molecule of the present invention encoding one or more recombination sites or portions thereof may be obtained using standard cloning and screening procedures, such as those for cloning cDNAs using mRNA as starting material. Preferred such methods include PCR-based cloning methods, such as reverse transcriptase-PCR(RT-PCR) using primers such as those described herein and in the Examples below. Alternatively, vectors comprising the cassettes containing the recombination site sequences described herein are available commercially from Life Technologies, Inc. (Rockville, Md.).

The invention is also directed to nucleic acid molecules comprising one or more of the recombination site sequences or portions thereof and one or more additional nucleotide sequences, which may encode functional or structural sites such as one or more multiple cloning sites, one or more transcription termination sites, one or more transcriptional regulatory sequences (which may be promoters, enhancers, repressors, and the like), one or more translational signals (e.g., secretion signal sequences), one or more origins of replication, one or more fusion partner peptides (particularly glutathione S-transferase (GST), hexahistidine ($His_6$), and thioredoxin (Trx)), one or more selection markers or modules, one or more nucleotide sequences encoding localization signals such as nuclear localization signals or secretion signals, one or more origins of replication, one or more protease cleavage sites, one or more genes or portions of genes encoding a protein or polypeptide of interest, and one or more 5' polynucleotide extensions (particularly an extension of guanine residues ranging in length from about 1 to about 20, from about 2 to about 15, from about 3 to about 10, from about 4 to about 10, and most preferably an extension of 4 or 5 guanine residues at the 5' end of the recombination site nucleotide sequence. The one or more additional functional or structural sequences may or may not flank one or more of the recombination site sequences contained on the nucleic acid molecules of the invention.

In some nucleic acid molecules of the invention, the one or more nucleotide sequences encoding one or more additional functional or structural sites may be operably linked to the nucleotide sequence encoding the recombination site. For example, certain nucleic acid molecules of the invention may have a promoter sequence operably linked to a nucleotide sequence encoding a recombination site or portion thereof of the invention, such as a T7 promoter, a phage lambda PL promoter, an E. coli lac, trp or tac promoter, and other suitable promoters which will be familiar to the skilled artisan.

Nucleic acid molecules of the present invention, which may be isolated nucleic acid molecules, may be in the form of RNA, such as mRNA, or in the form of DNA, including, for instance, cDNA and genomic DNA obtained by cloning or produced synthetically, or in the form of DNA-RNA hybrids. The nucleic acid molecules of the invention may be double-stranded or single-stranded. Single-stranded DNA or RNA may be the coding strand, also known as the sense strand, or it may be the non-coding strand, also referred to as the anti-sense strand. The nucleic acid molecules of the invention may also have a number of topologies, including linear, circular, coiled, or supercoiled.

By "isolated" nucleic acid molecule(s) is intended a nucleic acid molecule, DNA or RNA, which has been removed from its native environment. For example, recombinant DNA molecules contained in a vector are considered isolated for the purposes of the present invention. Further examples of isolated DNA molecules include recombinant DNA molecules maintained in heterologous host cells, and those DNA molecules purified (partially or substantially) from a solution whether produced by recombinant DNA or synthetic chemistry techniques. Isolated RNA molecules include in vivo or in vitro RNA transcripts of the DNA molecules of the present invention.

The present invention further relates to mutants, fragments, variants and derivatives of the nucleic acid molecules of the present invention, which encode portions, analogs or derivatives of one or more recombination sites. Variants may occur naturally, such as a natural allelic variant. By an "allelic variant" is intended one of several alternate forms of a gene occupying a given locus on a chromosome of an organism (see Lewin, B., ed., *Genes II*, John Wiley & Sons, New York (1985)). Non-naturally occurring variants may be produced using art-known mutagenesis techniques, such as those described hereinbelow.

Such variants include those produced by nucleotide substitutions, deletions or additions or portions thereof, or combinations thereof. The substitutions, deletions or additions may involve one or more nucleotides. The variants may be altered in coding regions, non-coding regions, or both. Alterations in the coding regions may produce conservative or non-conservative amino acid substitutions, deletions or additions. Especially preferred among these are silent substitutions, additions and deletions, which do not alter the properties and activities of the encoded polypeptide(s) or portions thereof, and which also do not substantially alter the reactivities of the recombination site nucleic acid sequences in recombination reactions. Also especially preferred in this regard are conservative substitutions.

Particularly preferred mutants, fragments, variants, and derivatives of the nucleic acid molecules of the invention include, but are not limited to, insertions, deletions or substitutions of one or more nucleotide bases within the 15 bp core region (GCTTTTTTATACTAA) (SEQ ID NO:9) which is identical in all four wildtype lambda att sites, attB, attP, attL and attR (see U.S. application Ser. Nos. 08/663,002, filed Jun. 7, 1996 (now U.S. Pat. No. 5,888,732), 09/005,476, filed Jan. 12, 1998, and 09/177,387, filed Oct. 23, 1998, which describes the core region in further detail, and the disclosures of which are incorporated herein by reference in their entireties). Analogously, the core regions in attB1, attP1, attL1 and attR1 are identical to one another, as are the core regions in attB2, attP2, attL2 and attR2. Particularly preferred in this regard are nucleic acid molecules comprising insertions, deletions or substitutions of one or more nucleotides within the seven bp overlap region (TTTATAC, which is defined by the cut sites for the integrase protein and is the region where strand exchange takes place) that occurs within this 15 bp core region (GCTTTTTTATACTAA) (SEQ ID NO:9).

Examples of such preferred mutants, fragments, variants and derivatives according to this aspect of the invention include, but are not limited to, nucleic acid molecules in which the thymine at position 1 of the seven bp overlap region has been deleted or substituted with a guanine, cytosine, or adenine; in which the thymine at position 2 of the seven bp overlap region has been deleted or substituted with a guanine, cytosine, or adenine; in which the thymine at position 3 of the seven bp overlap region has been deleted or substituted with a guanine, cytosine, or adenine; in which the adenine at position 4 of the seven bp overlap region has been deleted or substituted with a guanine, cytosine, or thymine; in which the thymine at position 5 of the seven bp overlap region has been deleted or substituted with a guanine, cytosine, or adenine; in which the adenine at position 6 of the seven bp overlap region has been deleted or substituted with a guanine, cytosine, or thymine; and in which the cytosine at position 7 of the seven bp overlap region has been deleted or substituted with a guanine, thymine, or adenine; or any combination of one or more such deletions and/or substitutions within this seven bp overlap region. As described in detail in Example 21 herein, mutants of the nucleic acid molecules of the invention in which substitutions have been made within the first three positions of the seven bp overlap (TTTATAC) have been found in the present invention to strongly affect the specificity of recombination, mutant nucleic acid molecules in which substitutions have been made in the last four positions (TTTATAC) only partially alter recombination specificity, and mutant nucleic acid molecules comprising nucleotide substitutions outside of the seven bp overlap, but elsewhere within the 15 bp core region, do not affect specificity of recombination but do influence the efficiency of recombination. Hence, in an additional aspect, the present invention is also directed to nucleic acid molecules comprising one or more recombination site nucleotide sequences that affect recombination specificity, particularly one or more nucleotide sequences that may correspond substantially to the seven base pair overlap within the 15 bp core region, having one or more mutations that affect recombination specificity. Particularly preferred such molecules may comprise a consensus sequence (described in detail in Example 21 herein) such as NNNATAC, wherein "N" refers to any nucleotide (i.e., may be A, G, T/U or C), with the proviso that if one of the first three nucleotides in the consensus sequence is a T/U, then at least one of the other two of the first three nucleotides is not a T/U.

In a related aspect, the present invention is also directed to nucleic acid molecules comprising one or more recombination site nucleotide sequences that enhance recombination efficiency, particularly one or more nucleotide sequences that may correspond substantially to the core region and having one or more mutations that enhance recombination efficiency. By sequences or mutations that "enhance recombination efficiency" is meant a sequence or mutation in a recombination site, preferably in the core region (e.g., the 15 bp core region of att recombination sites), that results in an increase in cloning efficiency (typically measured by determining successful cloning of a test sequence, e.g., by determining CFU/ml for a given cloning mixture) when recombining molecules comprising the mutated sequence or core region as compared to molecules that do not comprise the mutated sequence or core region (e.g., those comprising a wildtype recombination site core region sequence). More specifically, whether or not a given sequence or mutation enhances recombination efficiency may be determined using the sequence or mutation in recombinational cloning as described herein, and determining whether the sequence or mutation provides enhanced recombinational cloning efficiency when compared to a non-mutated (e.g., wildtype) sequence. Methods of determining preferred cloning efficiency-enhancing mutations for a number of recombination sites, particularly for att recombination sites, are described herein, for example in Examples 22-25. Examples of preferred such mutant recombination sites include but are not limited to the attL consensus core sequence of caacttnntnnnannaagttg (SEQ ID NO:92) (wherein "n" represents any nucleotide), for example the attL5 sequence agcctgctttattatactaagttggcatta (SEQ ID NO:10) and the attL6 sequence agcctgcttttttatattaagttggcatta (SEQ ID NO:11); the attB1.6 sequence ggggacaactttgtacaaaaaagttggct (SEQ ID NO:12); the attB2.2 sequence ggggacaactttgtacaagaaagctgggt (SEQ ID NO:13); and the attB2.10 sequence ggggacaactttgtacaagaaagttgggt (SEQ ID NO:14). Those of skill in the art will appreciate that, in addition to the core region, other portions of the att site may affect the efficiency of recombination. There are five so-called arm binding sites for the integrase protein in the bacteriophage lambda attP site, two in attR (P1 and P2), and three in attL (P'1, P'2 and P'3). Compared to the core binding sites, the integrase protein binds to arm sites with high affinity and interacts with core and arm sites through two different domains of the protein. As with the core binding site a consensus sequence for the arm binding site consisting of C/AAGTCACTAT (SEQ ID NO: 286) has been inferred from sequence comparison of the five arm binding sites and seven non-att sites (Ross and Landy, *Proc. Natl. Acad. Sci. USA* 79:7724-7728 (1982)). Each arm site has been mutated and tested for its effect in the excision and integration reactions (Numrych et al., *Nucl. Acids Res.* 18:3953 (1990)). Hence, specific sites are utilized in each reaction in different ways, namely, the P1 and P'3 sites are essential for the integration reaction whereas the other three sites are dispensable to the integration reaction to varying degrees. Similarly, the P2, P'1 and P'2 sites are most important for the excision reaction, whereas P1 and P'3 are completely dispensable. Interestingly, when P2 is mutated the integration reaction occurs more efficiently than with the wild type attP site. Similarly, when P1 and P'3 are mutated the excision reaction occurs more efficiently. The stimulatory effect of mutating integrase arm binding sites can be explained by removing sites that compete or inhibit a specific recombination pathway or that function in a reaction that converts products back to starting substrates. In fact there is evidence for an XIS-independent LR reaction (Abremski and Gottesman, *J. Mol. Biol.* 153:67-78 (1981)). Thus, in addition to modifications in the core region of the att site, the present invention contemplates the use of att sites containing one or more modifications in the integrase arm-type binding sites. In some preferred embodiments, one or more mutations may be introduced into one or more of the P1, PM, P2, P'2 and P'3 sites. In some preferred embodiments, multiple mutations may be introduced into one or more of these sites. Preferred such mutations include those which increase the recombination in vitro. For example, in some embodiments mutations may be introduced into the arm-type binding sites such that integrative recombination, corresponding to the BP reaction, is enhanced. In other embodiments, mutations may be introduced into the arm-type binding sites such that excisive recombination, corresponding to the LR reaction, is enhanced. Of course, based on the guidance contained herein, particularly in the construction and evaluation of effects of mutated recombination sites upon recombinational specificity and efficiency, analogous mutated or engineered sequences may be produced for other recombination sites described herein (including but not limited to lox, FRT, and the like) and used in accordance with the invention. For example, much like the mutagenesis strategy used to select core binding sites that enhance recombination efficiency, similar strategies can be employed to select changes in the arms of attP, attL and attR, and in analogous sequences in other recombination sites such as lox, FRT and the like, that enhance recombination efficiency. Hence, the construction and evaluation of such mutants is well within the abilities of those of ordinary skill in the art without undue experimentation. One suitable methodology for preparing and evaluating such mutations is found in Numrych, et al., (1990) *Nucleic Acids Research* 18(13): 3953-3959.

Other mutant sequences and nucleic acid molecules that may be suitable to enhance recombination efficiency will be apparent from the description herein, or may be easily determined by one of ordinary skill using only routine experimentation in molecular biology in view of the description herein and information that is readily available in the art Since the genetic code is well known in the art, it is also routine for one of ordinary skill in the art to produce degenerate variants of the nucleic acid molecules described herein without undue experimentation. Hence, nucleic acid molecules comprising degenerate variants of nucleic acid sequences encoding the recombination sites described herein are also encompassed within the scope of the invention.

Further embodiments of the invention include isolated nucleic acid molecules comprising a polynucleotide having a nucleotide sequence at least 50% identical, at least 60% identical, at least 70% identical, at least 75% identical, at least 80% identical, at least 85% identical, at least 90% identical, and more preferably at least 95%, 96%, 97%, 98% or 99% identical to the nucleotide sequences of the seven bp overlap region within the 15 bp core region of the recombination sites described herein, or the nucleotide sequences of attB1, attB2, attP1, attP2, attL1, attL2, attR1 or attR2 as set forth in FIG. 9 (or portions thereof), or a nucleotide sequence complementary to any of these nucleotide sequences, or fragments, variants, mutants, and derivatives thereof.

By a polynucleotide having a nucleotide sequence at least, for example, 95% "identical" to a reference nucleotide sequence encoding a particular recombination site or portion thereof is intended that the nucleotide sequence of the polynucleotide is identical to the reference sequence except that the polynucleotide sequence may include up to five point mutations (e.g., insertions, substitutions, or deletions) per each 100 nucleotides of the reference nucleotide sequence encoding the recombination site. For example, to obtain a polynucleotide having a nucleotide sequence at least 95% identical to a reference attB1 nucleotide sequence, up to 5% of the nucleotides in the attB1 reference sequence may be deleted or substituted with another nucleotide, or a number of nucleotides up to 5% of the total nucleotides in the attB1 reference sequence may be inserted into the attB1 reference sequence. These mutations of the reference sequence may occur at the 5' or 3' terminal positions of the reference nucleotide sequence or anywhere between those terminal positions, interspersed either individually among nucleotides in the reference sequence or in one or more contiguous groups within the reference sequence.

As a practical matter, whether any particular nucleic acid molecule is at least 50%, 60%, 70%, 75%, 80%, 85%, 90%, 95%, 96%, 97%, 98% or 99% identical to, for instance, a given recombination site nucleotide sequence or portion thereof can be determined conventionally using known computer programs such as DNAsis software (Hitachi Software, San Bruno, Calif.) for initial sequence alignment followed by ESEE version 3.0 DNA/protein sequence software (cabot@trog.mbb.sfu.ca) for multiple sequence alignments. Alternatively, such determinations may be accomplished using the BESTFIT program (Wisconsin Sequence Analysis Package, Genetics Computer Group, University Research Park, 575 Science Drive, Madison, Wis. 53711), which employs a local homology algorithm (Smith and Waterman, *Advances in Applied Mathematics* 2: 482-489 (1981)) to find the best segment of homology between two sequences. When using DNAsis, ESEE, BESTFIT or any other sequence alignment program to determine whether a particular sequence is, for instance, 95% identical to a reference sequence according to the present invention, the parameters are set such that the percentage of identity is calculated over the full length of the reference nucleotide sequence and that gaps in homology of up to 5% of the total number of nucleotides in the reference sequence are allowed.

The present invention is directed to nucleic acid molecules at least 50%, 60%, 70%, 75%, 80%, 85%, 90%, 95%, 96%, 97%, 98% or 99% identical to the attB1, attB2, attP1, attP2, attL1, attL2, attR1 or attR2 nucleotide sequences as set forth in FIG. 9, or to the nucleotide sequence of the deposited clones, irrespective of whether they encode particular functional polypeptides. This is because even where a particular nucleic acid molecule does not encode a particular functional polypeptide, one of skill in the art would still know how to use the nucleic acid molecule, for instance, as a hybridization probe or a polymerase chain reaction (PCR) primer.

Mutations can also be introduced into the recombination site nucleotide sequences for enhancing site specific recombination or altering the specificities of the reactants, etc. Such mutations include, but are not limited to: recombination sites without translation stop codons that allow fusion proteins to be encoded; recombination sites recognized by the same proteins but differing in base sequence such that they react largely or exclusively with their homologous partners allowing multiple reactions to be contemplated; and mutations that prevent hairpin formation of recombination sites. Which particular reactions take place can be specified by which particular partners are present in the reaction mixture.

There are well known procedures for introducing specific mutations into nucleic acid sequences. A number of these are described in Ausubel, F. M. et al., *Current Protocols in Molecular Biology*, Wiley Interscience, New York (1989-1996). Mutations can be designed into oligonucleotides, which can be used to modify existing cloned sequences, or in amplification reactions. Random mutagenesis can also be employed if appropriate selection methods are available to isolate the desired mutant DNA or RNA. The presence of the desired mutations can be confirmed by sequencing the nucleic acid by well known methods.

The following non-limiting methods can be used to modify or mutate a given nucleic acid molecule encoding a particular recombination site to provide mutated sites that can be used in the present invention:

1. By recombination of two parental DNA sequences by site-specific (e.g. attL and attR to give attP) or other (e.g. homologous) recombination mechanisms where the parental DNA segments contain one or more base alterations resulting in the final mutated nucleic acid molecule;
2. By mutation or mutagenesis (site-specific, PCR, random, spontaneous, etc) directly of the desired nucleic acid molecule;
3. By mutagenesis (site-specific, PCR, random, spontaneous, etc) of parental DNA sequences, which are recombined to generate a desired nucleic acid molecule;
4. By reverse transcription of an RNA encoding the desired core sequence; and 5. By de novo synthesis (chemical synthesis) of a sequence having the desired base changes, or random base changes followed by sequencing or functional analysis according to methods that are routine in the art.

The functionality of the mutant recombination sites can be demonstrated in ways that depend on the particular characteristic that is desired. For example, the lack of translation stop codons in a recombination site can be demonstrated by expressing the appropriate fusion proteins. Specificity of recombination between homologous partners can be demonstrated by introducing the appropriate molecules into in vitro reactions, and assaying for recombination products as described herein or known in the art. Other desired mutations in recombination sites might include the presence or absence of restriction sites, translation or transcription start signals, protein binding sites, particular coding sequences, and other known functionalities of nucleic acid base sequences. Genetic selection schemes for particular functional attributes in the recombination sites can be used according to known method steps. For example, the modification of sites to provide (from a pair of sites that do not interact) partners that do interact could be achieved by requiring deletion, via recombination between the sites, of a DNA sequence encoding a toxic substance. Similarly, selection for sites that remove translation stop sequences, the presence or absence of protein binding sites, etc., can be easily devised by those skilled in the art.

Accordingly, the present invention also provides a nucleic acid molecule, comprising at least one DNA segment having at least one, and preferably at least two, engineered recombination site nucleotide sequences of the invention flanking a selectable marker and/or a desired DNA segment, wherein at least one of said recombination site nucleotide sequences has at least one engineered mutation that enhances recombination in vitro in the formation of a Cointegrate DNA or a Product DNA. Such engineered mutations may be in the core sequence of the recombination site nucleotide sequence of the invention; see U.S. application Ser. Nos. 08/486,139, filed Jun. 7, 1995, 08/663,002, filed Jun. 7, 1996 (now U.S. Pat. No. 5,888,732), 09/005,476, filed Jan. 12, 1998, and 09/177,387, filed Oct. 23, 1998, the disclosures of which are all incorporated herein by reference in their entireties.

While in the preferred embodiment the recombination sites differ in sequence and do not interact with each other, it is recognized that sites comprising the same sequence, which may interact with each other, can be manipulated or engineered to inhibit recombination with each other. Such conceptions are considered and incorporated herein. For example, a protein binding site (e.g., an antibody-binding site, a histone-binding site, an enzyme-binding site, or a binding site for any nucleic acid molecule-binding protein) can be engineered adjacent to one of the sites. In the presence of the protein that recognizes the engineered site, the recombinase fails to access the site and another recombination site in the nucleic acid molecule is therefore used preferentially. In the cointegrate this site can no longer react since it has been changed, e.g., from attB to attL. During or upon resolution of the cointegrate, the protein can be inactivated (e.g., by antibody, heat or a change of buffer) and the second site can undergo recombination.

The nucleic acid molecules of the invention can have at least one mutation that confers at least one enhancement of said recombination, said enhancement selected from the group consisting of substantially (i) favoring integration; (ii) favoring recombination; (iii) relieving the requirement for host factors; (iv) increasing the efficiency of said Cointegrate DNA or Product DNA formation; (v) increasing the specificity of said Cointegrate DNA or Product DNA formation; and (v) adding or deleting protein binding sites.

In other embodiments, the nucleic acid molecules of the invention may be PCR primer molecules, which comprise one or more of the recombination site sequences described herein or portions thereof, particularly those shown in FIG. 9 (or sequences complementary to those shown in FIG. 9), or mutants, fragments, variants or derivatives thereof, attached at the 3' end to a target-specific template sequence which specifically interacts with a target nucleic acid molecule which is to be amplified. Primer molecules according to this aspect of the invention may further comprise one or more, (e.g., 1, 2, 3, 4, 5, 10, 20, 25, 50, 100, 500, 1000, or more) additional bases at their 5' ends, and preferably comprise one or more (particularly four or five) additional bases, which are preferably guanines, at their 5' ends, to increase the efficiency of the amplification products incorporating the primer molecules in the recombinational cloning system of the invention. Such nucleic acid molecules and primers are described in detail in the examples herein, particularly in Examples 22-25.

Certain primers of the invention may comprise one or more nucleotide deletions in the attB1, attB2, attP1, attP2, attL1, attL2, attR1 or attR2 sequences as set forth in FIG. 9. In one such aspect, for example, attB2 primers may be constructed in which one or more of the first four nucleotides at the 5' end of the attB2 sequence shown in FIG. 9 have been deleted. Primers according to this aspect of the invention may therefore have the sequence:

```
(attB2(-1)):
                                    (SEQ ID NO: 15)
CCCAGCTTTCTTGTACAAAGTGGTnnnnnnnnnnnnn...n (attB2(-2)):
                                    (SEQ ID NO: 16)
CCAGCTTTCTTGTACAAAGTGGTnnnnnnnnnnnnn...n (attB2(-3)):
                                    (SEQ ID NO: 17)
CAGCTTTCTTGTACAAAGTGGTnnnnnnnnnnnnn...n (attB2(-4)):
                                    (SEQ ID NO: 18)
AGCTTTCTTGTACAAAGTGGTnnnnnnnnnnnnn...n,
```

Wherein "nnnnnnnnnnnnn . . . n" at the 3' end of the primer represents a target-specific sequence of any length, for example from one base up to all of the bases of a target nucleic acid molecule (e.g., a gene) or a portion thereof, the sequence and length which will depend upon the identity of the target nucleic acid molecule which is to be amplified.

The primer nucleic acid molecules according to this aspect of the invention may be produced synthetically by attaching the recombination site sequences depicted in FIG. 9, or portions thereof, to the 5' end of a standard PCR target-specific primer according to methods that are well-known in the art. Alternatively, additional primer nucleic acid molecules of the invention may be produced synthetically by adding one or more nucleotide bases, which preferably correspond to one or more, preferably five or more, and more preferably six or more, contiguous nucleotides of the att nucleotide sequences described herein (see, e.g., Example 20 herein; see also U.S. application Ser. Nos. 08/663,002, filed Jun. 7, 1996 (now U.S. Pat. No. 5,888,732), 09/005,476, filed Jan. 12, 1998, and 09/177,387, filed Oct. 23, 1998, the disclosures of which are all incorporated herein by reference in their entireties), to the 5' end of a standard PCR target-specific primer according to methods that are well-known in the art, to provide primers having the specific nucleotide sequences described herein. As noted above, primer nucleic acid molecules according to this aspect of the invention may also optionally comprise one, two, three, four, five, or more additional nucleotide bases at their 5' ends, and preferably will comprise four or five guanines at their 5' ends. In one particularly preferred such aspect, the primer nucleic acid molecules of the invention may comprise one or more, preferably five or more, more preferably six or more, still more preferably 6-18 or 6-25, and most preferably 6, 7, 8, 9, 10, 11, 12, 13, 14, 15, 16, 17, 18, 19, 20, 21, 22, 23, 24 or 25, contiguous nucleotides or by of the attB1 or attB2 nucleotide sequences depicted in FIG. 9 (or nucleotides complementary thereto), linked to the 5' end of a target-specific (e.g., a gene-specific) primer molecule. Primer nucleic acid molecules according to this aspect of the invention include, but are not limited to, attB1- and attB2-derived primer nucleic acid molecules having the following nucleotide sequences:

```
                                       (SEQ ID NO: 19)
ACAAGTTTGTACAAAAAAGCAGGCT-nnnnnnnnnnnnn...n (SEQ ID NO: 20)
ACCACTTTGTACAAGAAAGCTGGGT-nnnnnnnnnnnnn...n (SEQ ID NO: 21)
TGTACAAAAAAGCAGGCT-nnnnnnnnnnnnn...n (SEQ ID NO: 22)
TGTACAAGAAAGCTGGGT-nnnnnnnnnnnnn...n (SEQ ID NO: 23)
ACAAAAAAGCAGGCT-nnnnnnnnnnnnn...n (SEQ ID NO: 24)
ACAAGAAAGCTGGGT-nnnnnnnnnnnnn...n (SEQ ID NO: 25)
AAAAAGCAGGCT-nnnnnnnnnnnnn...n (SEQ ID NO: 26)
AGAAAGCTGGGT-nnnnnnnnnnnnn...n (SEQ ID NO: 27)
AAAAGCAGGCT-nnnnnnnnnnnnn...n (SEQ ID NO: 28)
GAAAGCTGGGT-nnnnnnnnnnnnn...n (SEQ ID NO: 29)
AAAGCAGGCT-nnnnnnnnnnnnn...n (SEQ ID NO: 30)
AAAGCTGGGT-nnnnnnnnnnnnn...n AAGCAGGCT-nnnnnnnnnnnnn...n AAGCTGGGT-nnnnnnnnnnnnn...n AGCAGGCT-nnnnnnnnnnnnn...n AGCTGGGT-nnnnnnnnnnnnn...n GCAGGCT-nnnnnnnnnnnnn...n GCTGGGT-nnnnnnnnnnnnn...n CAGGCT-nnnnnnnnnnnnn...n CTGGGT-nnnnnnnnnnnnn...n,
``` wherein "nnnnnnnnnnnnn . . . n" at the 3' end of the primer represents a target-specific sequence of any length, for example from one base up to all of the bases of a target nucleic acid molecule (e.g., a gene) or a portion thereof, the sequence and length which will depend upon the identity of the target nucleic acid molecule which is to be amplified.

Of course, it will be apparent to one of ordinary skill from the teachings contained herein that additional primer nucleic acid molecules analogous to those specifically described herein may be produced using one or more, preferably five or more, more preferably six or more, still more preferably ten or more, 15 or more, 20 or more, 25 or more, 30 or more, etc. (through to and including all) of the contiguous nucleotides or bp of the attP1, attP2, attL1, attL2, attR1 or attR2 nucleotide sequences depicted in FIG. 9 (or nucleotides complementary thereto), linked to the 5' end of a target-specific (e.g., a gene-specific) primer molecule. As noted above, such primer nucleic acid molecules may optionally further comprise one, two, three, four, five, or more additional nucleotide bases at their 5' ends, and preferably will comprise four guanines at their 5' ends. Other primer molecules comprising the attB1, attB2, attP1, attP2, attL1, attL2, attR1 and attR2 sequences depicted in FIG. 9, or portions thereof, may be made by one of ordinary skill without resorting to undue experimentation in accordance with the guidance provided herein.

The primers of the invention described herein are useful in producing PCR fragments having a nucleic acid molecule of interest flanked at each end by a recombination site sequence (as described in detail below in Example 9), for use in cloning of PCR-amplified DNA fragments using the recombination system of the invention (as described in detail below in Examples 8, 19 and 21-25).

Vectors

The invention also relates to vectors comprising one or more of the nucleic acid molecules of the invention, as described herein. In accordance with the invention, any vector may be used to construct the vectors of the invention. In particular, vectors known in the art and those commercially available (and variants or derivatives thereof) may in accordance with the invention be engineered to include one or more nucleic acid molecules encoding one or more recombination sites (or portions thereof), or mutants, fragments, or derivatives thereof, for use in the methods of the invention. Such vectors may be obtained from, for example, Vector Laboratories Inc., InVitrogen, Promega, Novagen, New England Biolabs, Clontech, Roche, Pharmacia, EpiCenter, OriGenes Technologies Inc., Stratagene, Perkin Elmer, Pharmingen, Life Technologies, Inc., and Research Genetics. Such vectors may then for example be used for cloning or subcloning nucleic acid molecules of interest. General classes of vectors of particular interest include prokaryotic and/or eukaryotic cloning vectors, Expression Vectors, fusion vectors, two-hybrid or reverse two-hybrid vectors, shuttle vectors for use in different hosts, mutagenesis vectors, transcription vectors, vectors for receiving large inserts and the like.

Other vectors of interest include viral origin vectors (M13 vectors, bacterial phage λ vectors, bacteriophage P1 vectors, adenovirus vectors, herpesvirus vectors, retrovirus vectors, phage display vectors, combinatorial library vectors), high, low, and adjustable copy number vectors, vectors which have compatible replicons for use in combination in a single host (pACYC184 and pBR322) and eukaryotic episomal replication vectors (pCDM8).

Particular vectors of interest include prokaryotic Expression Vectors such as pcDNA II, pSL301, pSE280, pSE380, pSE420, pTrcHisA, B, and C, pRSET A, B, and C (Invitrogen, Inc.), pGEMEX-1, and pGEMEX-2 (Promega, Inc.), the pET vectors (Novagen, Inc.), pTrc99A, pKK223-3, the pGEX vectors, pEZZ18, pRIT2T, and pMC 1871 (Pharmacia, Inc.), pKK233-2 and pKK388-1 (Clontech, Inc.), and pProEx-HT (Life Technologies, Inc.) and variants and derivatives thereof. Destination Vectors can also be made from eukaryotic Expression Vectors such as pFastBac, pFastBac HT, pFastBac DUAL, pSFV, and pTet-Splice (Life Technologies, Inc.), pEUK-C1, pPUR, pMAM, pMAMneo, pBI101, pBI121, pDR2, pCMVEBNA, and pYACneo (Clontech), pSVK3, pSVL, pMSG, pCH110, and pKK232-8 (Pharmacia, Inc.), p3'SS, pXT1, pSG5, pPbac, pMbac, pMC1neo, and pOG44 (Stratagene, Inc.), and pYES2, pAC360, pBlueBacHisA, B, and C, pVL1392, pBsueBacIII, pCDM8, pcDNA1, pZeoSV, pcDNA3 pREP4, pCEP4, and pEBVHis (Invitrogen, Inc.) and variants or derivatives thereof.

Other vectors of particular interest include pUC18, pUC19, pBlueScript, pSPORT, cosmids, phagemids, YACs (yeast artificial chromosomes), BACs (bacterial artificial chromosomes), MACs (mammalian artificial chromosomes), pQE70, pQE60, pQE9 (Quiagen), pBS vectors, PhageScript vectors, BlueScript vectors, pNH8A, pNH16A, pNH18A, pNH46A (Stratagene), pcDNA3 (InVitrogen), pGEX, pTrsfus, pTrc99A, pET-5, pET-9, pKK223-3, pKK233-3, pDR540, pRIT5 (Pharmacia), pSPORT1, pSPORT2, pCMVSPORT2.0 and pSV-SPORT1 (Life Technologies, Inc.) and variants or derivatives thereof.

Additional vectors of interest include pTrxFus, pThioHis, pLEX, pTrcHis, pTrcHis2, pRSET, pBlueBacHis2, pcDNA3.1/His, pcDNA3.1 (−)/Myc-His, pSecTag, pEBVHis, pPIC9K, pPIC3.5K, pAO815, pPICZ, pPICZα, pGAPZ, pGAPZα, pBlueBac4.5, pBlueBacHis2, pMelBac, pSinRep5, pSinHis, pIND, pIND(SP1), pVgRXR, pcDNA2.1. pYES2, pZErO1.1, pZErO-2.1, pCR-Blunt, pSE280, pSE380, pSE420, pVL1392, pVL1393, pCDM8, pcDNA1.1, pcDNA 1.1/Amp, pcDNA3.1, pcDNA3.1/Zeo, pSe, SV2, pRc/CMV2, pRc/RSV, pREP4, pREP7, pREP8, pREP9, pREP10, pCEP4, pEBVHis, pCR3.1, pCR2.1, pCR3.1—Uni, and pCRBac from Invitrogen; λExCell, λgt11, pTrc99A, pKK223-3, pGEX-1λT, pGEX-2T, pGEX-2TK, pGEX-4T-1, pGEX-4T-2, pGEX-4T-3, pGEX-3X, pGEX-5X-1, pGEX-5X-2, pGEX-5X-3, pEZZ18, pRIT2T, pMC1871, pSVK3, pSVL, pMSG, pCH110, pKK232-8, pSL1180, pNEO, and pUC4K from Pharmacia; pSCREEN-1b(+), pT7Blue(R), pT7Blue-2, pCITE4abc(+), pOCUS-2, pTAg, pET-32 LIC, pET-30 LIC, pBAC-2 cp LIC, pBAC-gus-2 cp LIC, pT7Blue-2 LIC, pT7Blue-2, λSCREEN-1, λBlueSTAR, pET-3abcd, pET-7abc, pET9abcd, pET11abcd, pET12abc, pET-14b, pET-15b, pET-16b, pET-17b-pET-17xb, pET-19b, pET-20b(+), pET-21abcd(+), pET-22b(+), pET-23abcd(+), pET-24abcd(+), pET-25b(+), pET-26b(+), pET-27b(+), pET-28abc(+), pET-29abc(+), pET-30abc(+), pET-31b(+), pET-32abc(+), pET-33b(+), pBAC-1, pBAC-gus-1, pBAC4x-1, pBACgus4x-1, pBAC-3 cp, pBACgus-2 cp, pBACsurf-1, plg, Signal plg, pYX, Selecta Vecta-Neo, Selecta Vecta-Hyg, and Selecta Vecta-Gpt from Novagen; pLexA, pB42AD, pGBT9, pAS2-1, pGAD424, pACT2, pGAD GL, pGAD GH, pGAD10, pGilda, pEZM3, pEGFP, pEGFP-1, pEGFP-N, pEGFP-C, pEBFP, pGFPuv, pGFP, p6xHis-GFP, pSEAP2-Basic, pSEAP2-Contral, pSEAP2-Promoter, pSEAP2-Enhancer, pβgal-Basic, pβgal-Control, pβgal-Promoter, pβgal-Enhancer, pCMVβ, pTet-Off, pTet-On, pTK-Hyg, pRetro-Off, pRetro-On, pIRES1neo, pIRES1hyg, pLXSN, pLNCX, pLAPSN, pMAMneo, pMAMneo-CAT, pMAMneo-LUC, pPUR, pSV2neo, pYEX 4T-1/2/3, pYEX-S1, pBacPAK-His, pBacPAK8/9, pAcUW31, BacPAK6, pTriplEx, λgt10, λgt11, pWE15, and λTriplEx from Clontech; Lambda ZAP II, pBK-CMV, pBK-RSV, pBluescript II KS+/−, pBluescript II SK+/−, pAD-GAL4, pBD-GAL4 Cam, pSurfscript, Lambda FIX II, Lambda DASH, Lambda EMBL3, Lambda EMBL4, SuperCos, pCR-Scrigt Amp, pCR-Script Cam, pCR-Script Direct, pBS+/−, pBC KS+/−, pBC SK+/−, Phagescript, pCAL-n-EK, pCAL-n, pCAL-c, pCAL-kc, pET-3abcd, pET-11abcd, pSPUTK, pESP-1, pCMVLacI, pOPRSVI/MCS, pOPI3 CAT, pXT1, pSG5, pPbac, pMbac, pMC1neo, pMC1neo Poly A, pOG44, pOG45, pFRTβGAL, pNEOβGAL, pRS403, pRS404, pRS405, pRS406, pRS413, pRS414, pRS415, and pRS416 from Stratagene.

Two-hybrid and reverse two-hybrid vectors of particular interest include pPC86, pDBLeu, pDBTrp, pPC97, p2.5, pGAD1-3, pGAD10, pACt, pACT2, pGADGL, pGADGH, pAS2-1, pGAD424, pGBT8, pGBT9, pGAD-GAL4, pLexA, pBD-GAL4, pHISi, pHISi-1, placZi, pB42AD, pDG202, pJK202, pJG4-5, pNLexA, pYESTrp and variants or derivatives thereof.

Yeast Expression Vectors of particular interest include pESP-1, pESP-2, pESC-His, pESC-Trp, pESC-URA, pESC-Leu (Stratagene), pRS401, pRS402, pRS411, pRS412, pRS421, pRS422, and variants or derivatives thereof.

According to the invention, the vectors comprising one or more nucleic acid molecules encoding one or more recombination sites, or mutants, variants, fragments, or derivatives thereof, may be produced by one of ordinary skill in the art without resorting to undue experimentation using standard molecular biology methods. For example, the vectors of the invention may be produced by introducing one or more of the nucleic acid molecules encoding one or more recombination sites (or mutants, fragments, variants or derivatives thereof) into one or more of the vectors described herein, according to the methods described, for example, in Maniatis et al., *Molecular Cloning: A Laboratory Manual*, Cold Spring Harbor Laboratory, Cold Spring Harbor, N.Y. (1982). In a related aspect of the invention, the vectors may be engineered to contain, in addition to one or more nucleic acid molecules encoding one or more recombination sites (or portions thereof), one or more additional physical or functional nucleotide sequences, such as those encoding one or more multiple cloning sites, one or more transcription termination sites, one or more transcriptional regulatory sequences (e.g., one or more promoters, enhancers, or repressors), one or more selection markers or modules, one or more genes or portions of genes encoding a protein or polypeptide of interest, one or more translational signal sequences, one or more nucleotide sequences encoding a fusion partner protein or peptide (e.g., GST, $His_6$ or thioredoxin), one or more origins of replication, and one or more 5' or 3' polynucleotide tails (particularly a poly-G tail). According to this aspect of the invention, the one or more recombination site nucleotide sequences (or portions thereof) may optionally be operably linked to the one or more additional physical or functional nucleotide sequences described herein.

Figure 50A:
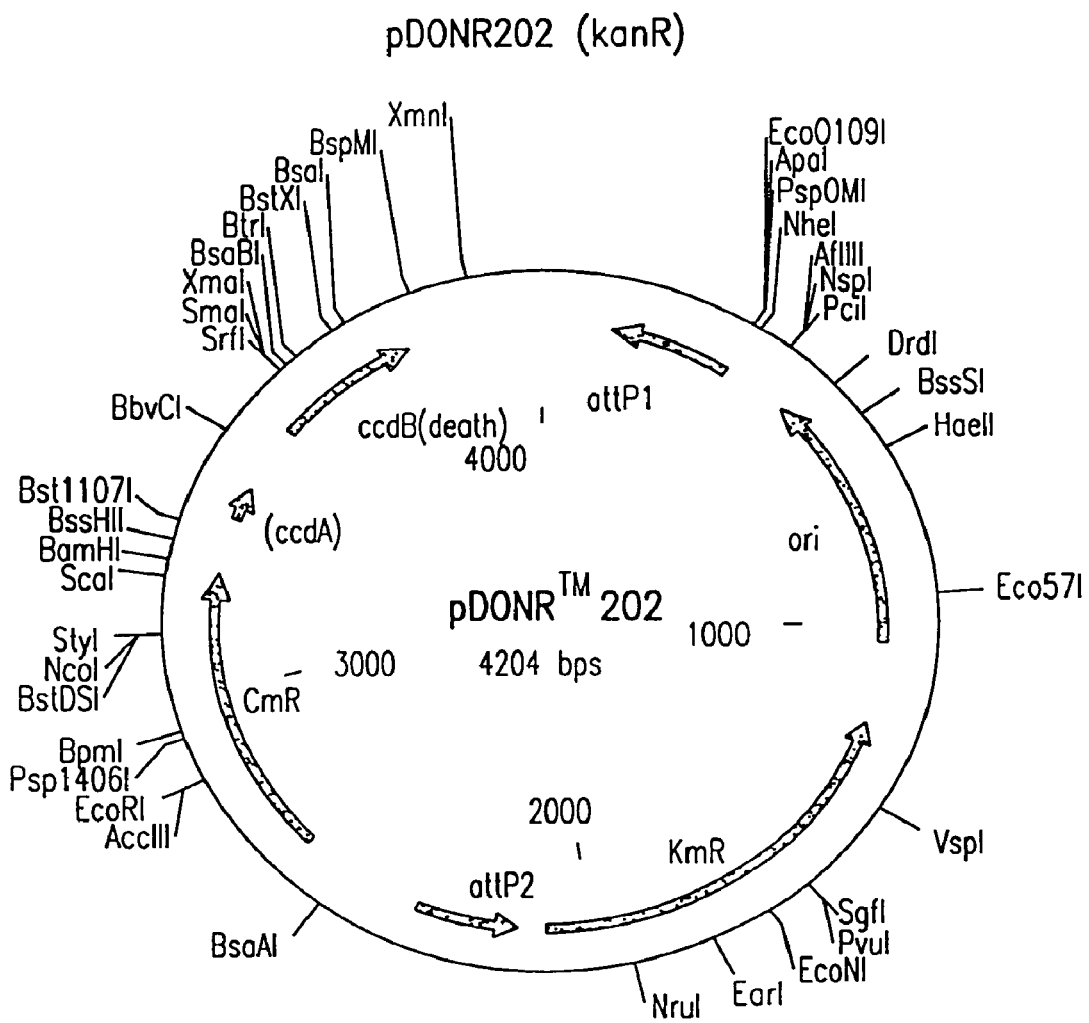
FIG. 50 is a depiction of the physical map (FIG. 50A), and the nucleotide sequence (FIGS. 50B-C) (SEQ ID NO:158), for the Donor plasmid pDONR202 which donates a kanamycin-resistant vector in the BP Reaction.
Figure 51A:
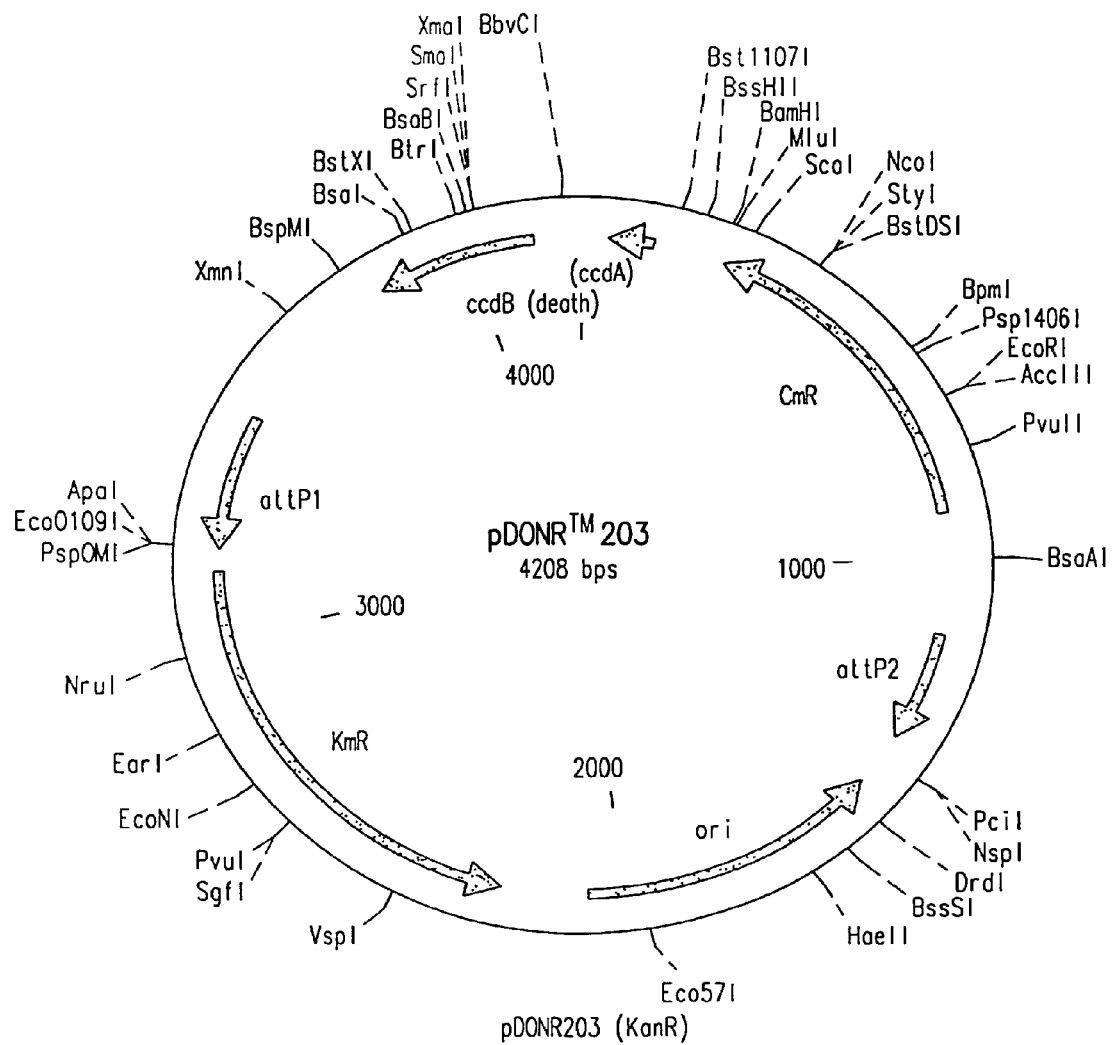
FIG. 51 is a depiction of the physical map (FIG. 51A), and the nucleotide sequence (FIGS. 51B-C) (SEQ ID NO:159), for the Donor plasmid pDONR203 which donates a kanamycin-resistant vector in the BP Reaction.
Figure 52A:
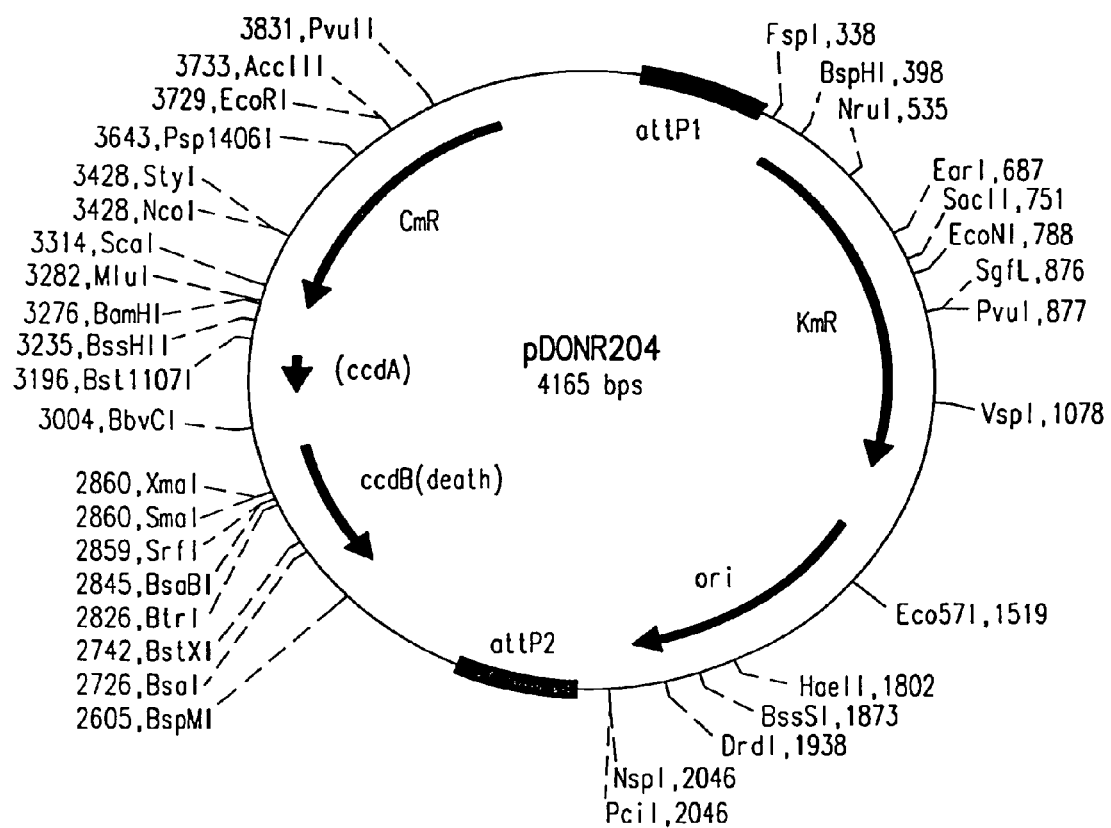
FIG. 52 is a depiction of the physical map (FIG. 52A), and the nucleotide sequence (FIGS. 52B-C) (SEQ ID NO:160), for the Donor plasmid pDONR204 which donates a kanamycin-resistant vector in the BP Reaction.
Figure 53A:
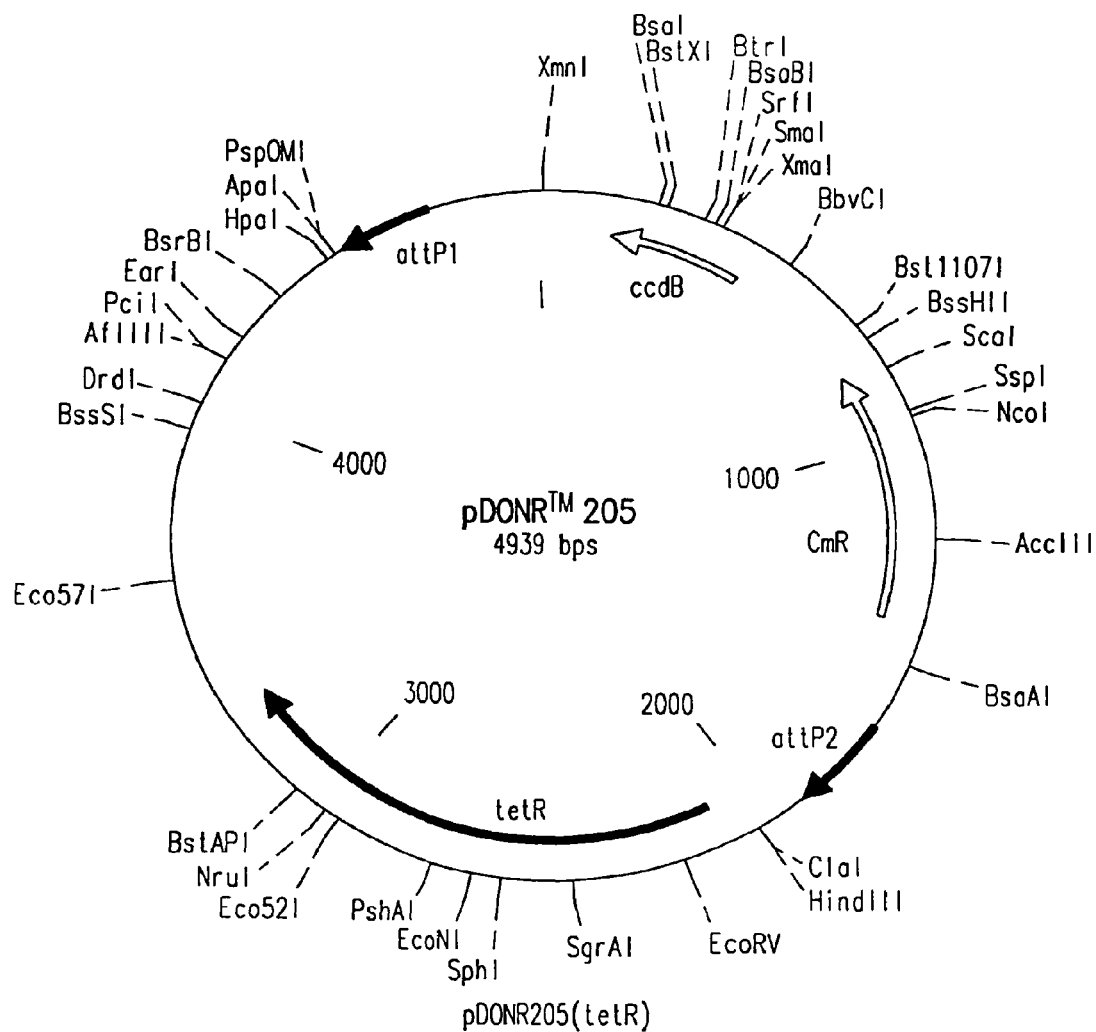
FIG. 53 is a depiction of the physical map (FIG. 53A), and the nucleotide sequence (FIGS. 53B-C) (SEQ ID NO:161), for the Donor plasmid pDONR205 which donates a tetracycline-resistant vector in the BP Reaction.
Figure 54A:
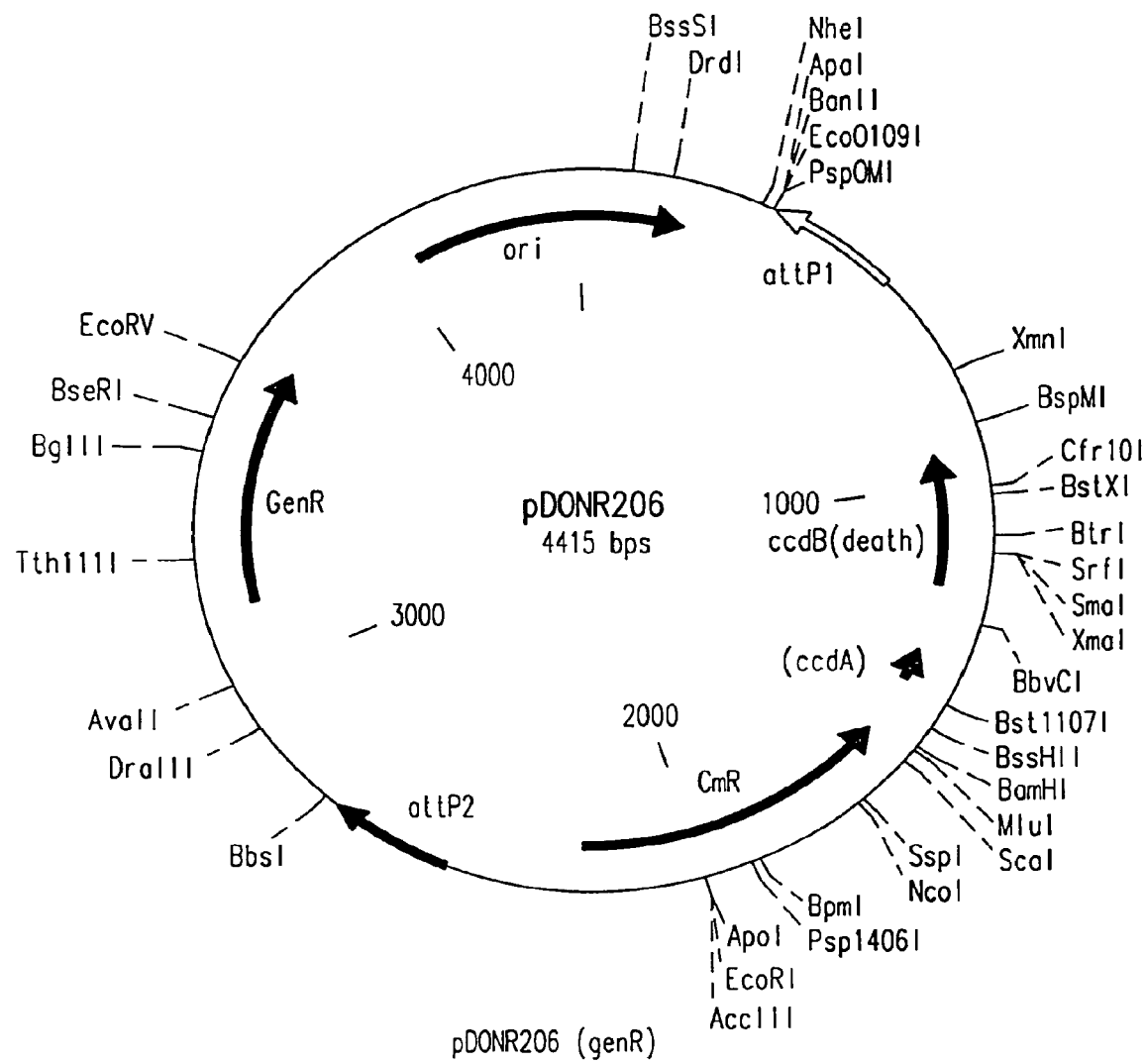
FIG. 54 is a depiction of the physical map (FIG. 54A), and the nucleotide sequence (FIGS. 54B-C) (SEQ ID NO:162), for the Donor plasmid pDONR206 which donates a gentamycin-resistant vector in the BP Reaction. This vector may also be referred to as pENTR22 attP Donor Plasmid, pAttP-Genr Donor Plasmid, or pAttPgent Donor Plasmid.
Figure 87:
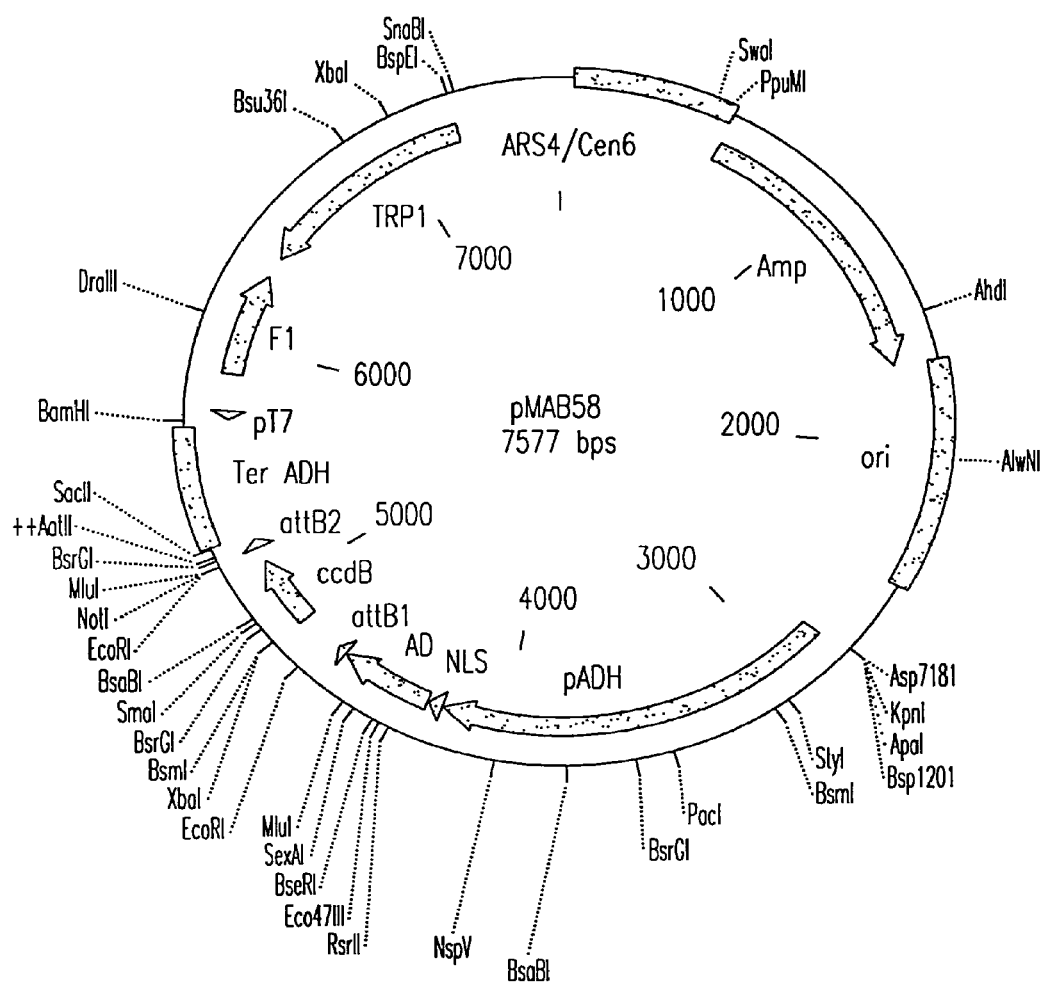
FIG. 87 is a physical map of plasmid pMAB58.
Figure 88:
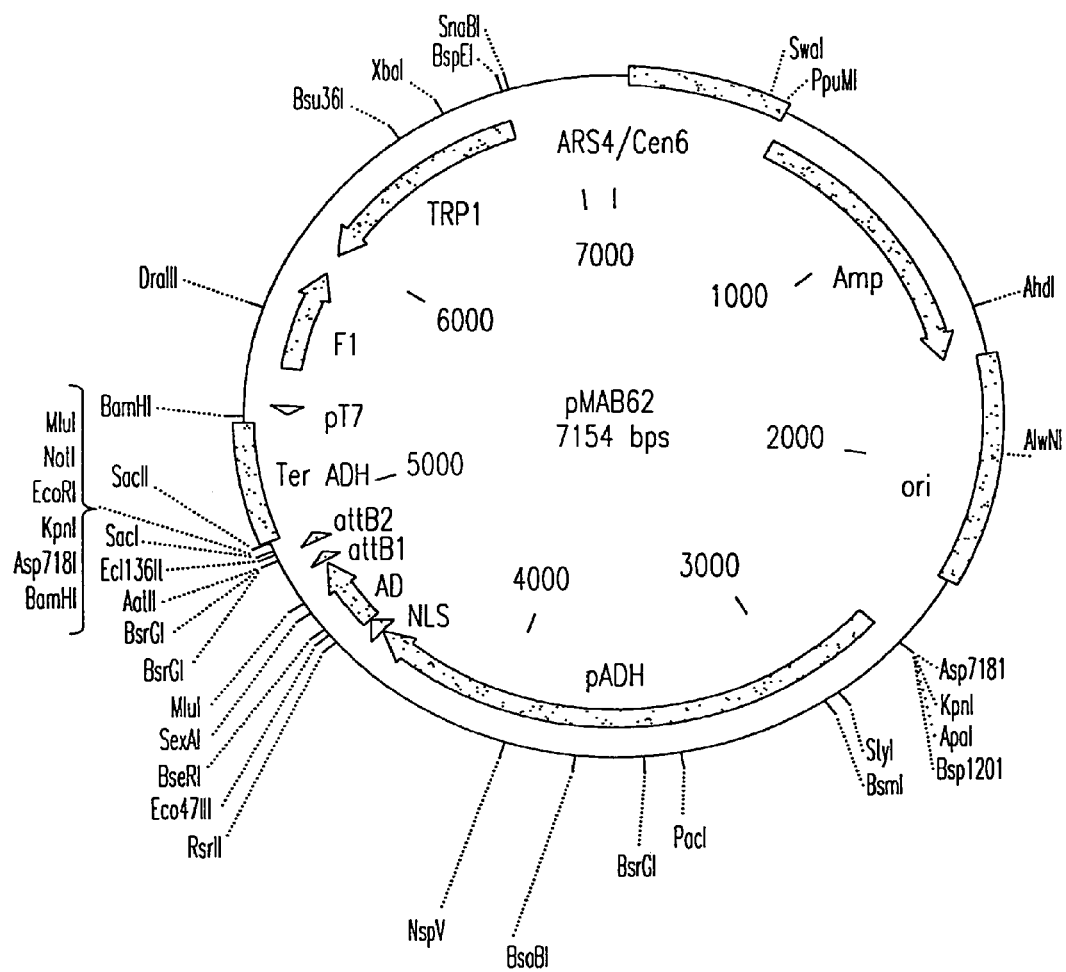
FIG. 88 is a physical map of plasmid pMAB62.
Figure 89:
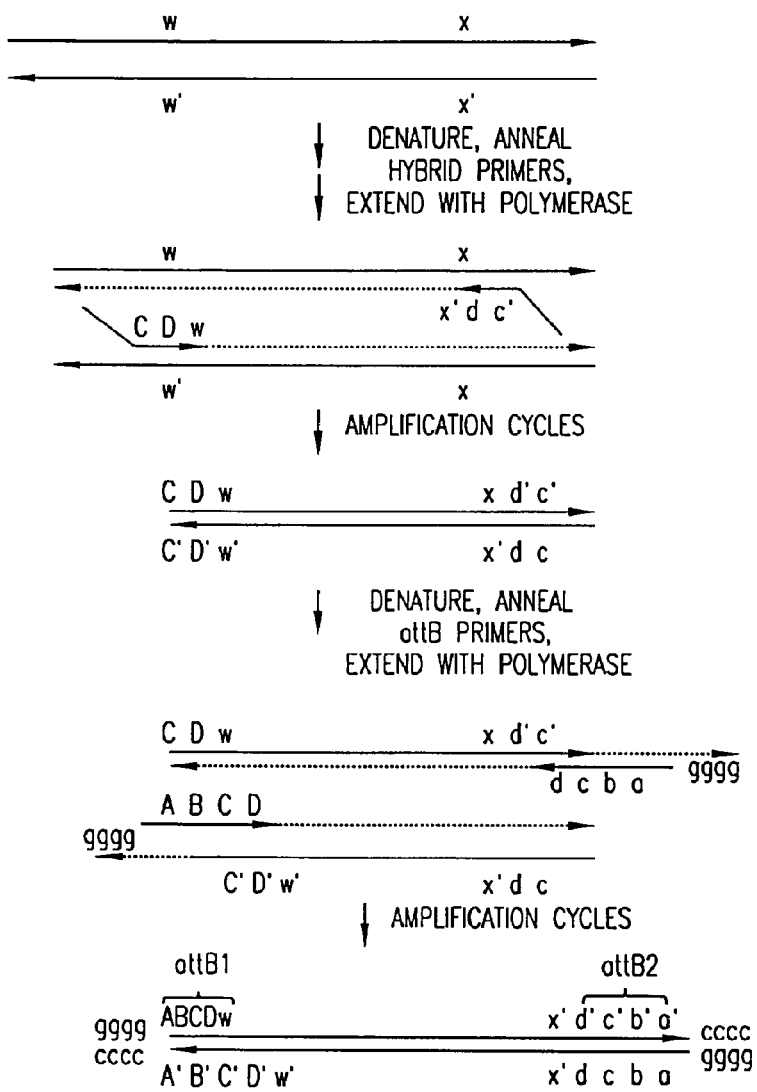
FIG. 89 is a depiction of a synthesis reaction using two pairs of homologous primers of the invention.
Figure 90A:
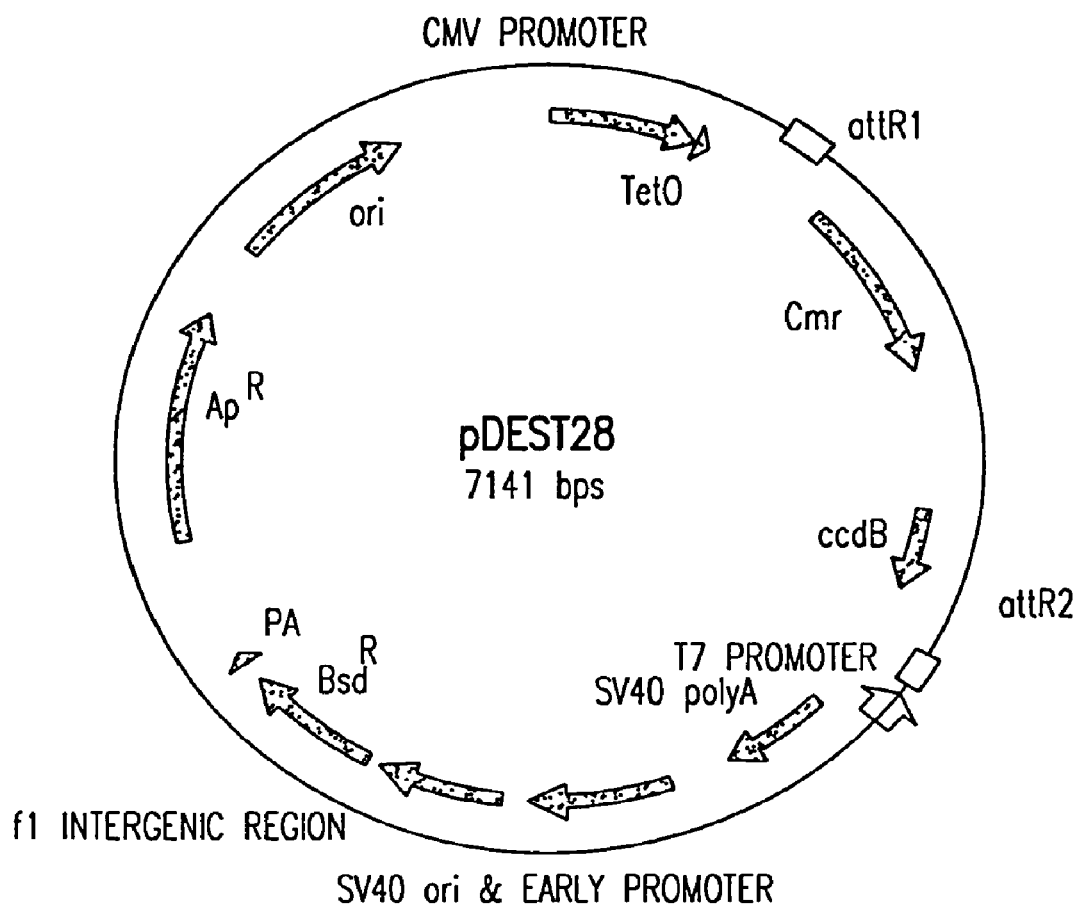
FIG. 90 is a schematic depiction of the physical map (FIG. 90A), and the nucleotide sequence (FIGS. 90B-D) (SEQ ID NO:175), of Destination Vector pDEST28.
Figure 91A:
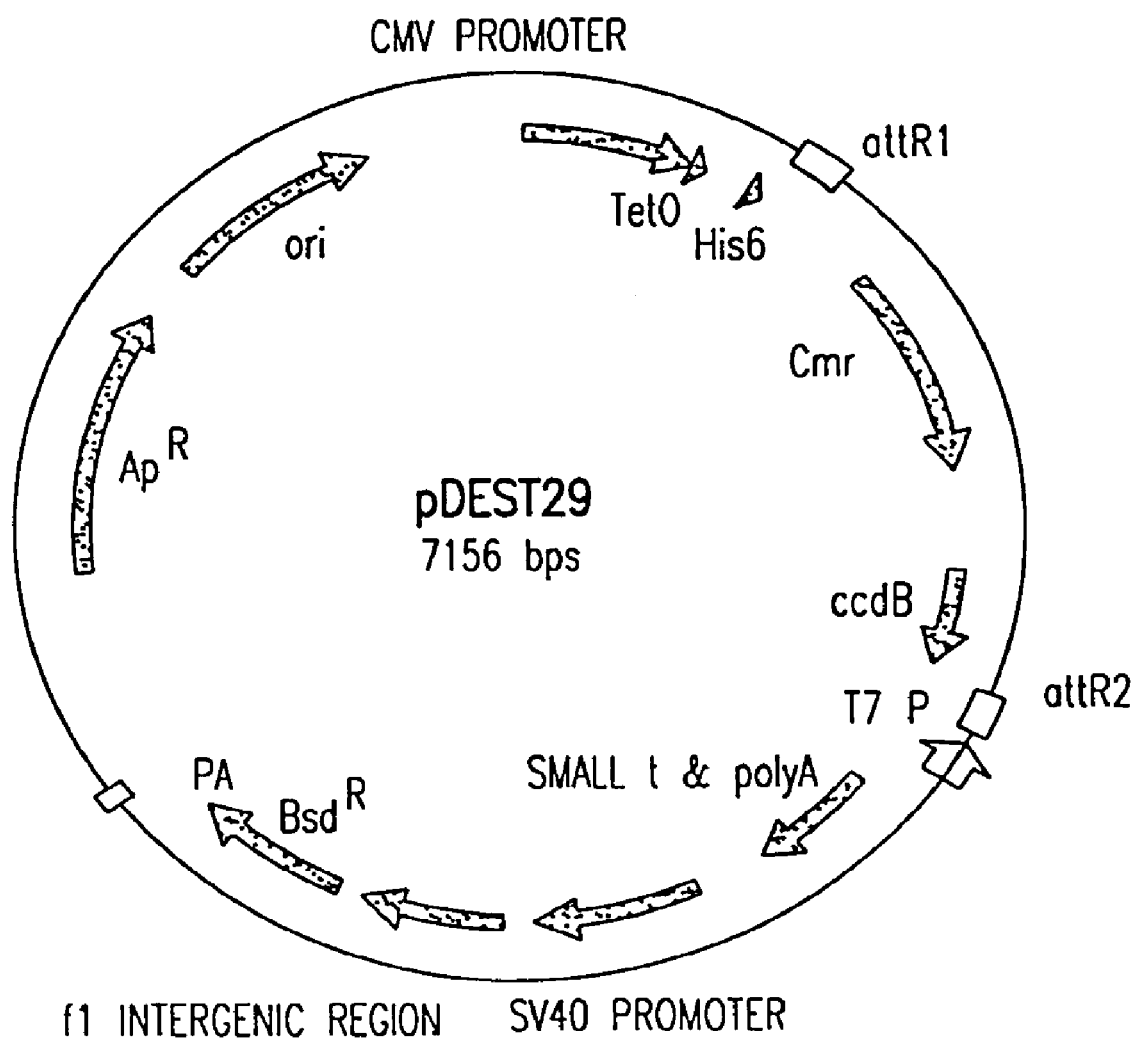
FIG. 91 is a schematic depiction of the physical map (FIG. 91A), and the nucleotide sequence (FIGS. 91B-D) (SEQ ID NO:176), of Destination Vector pDEST29.
Figure 92A:
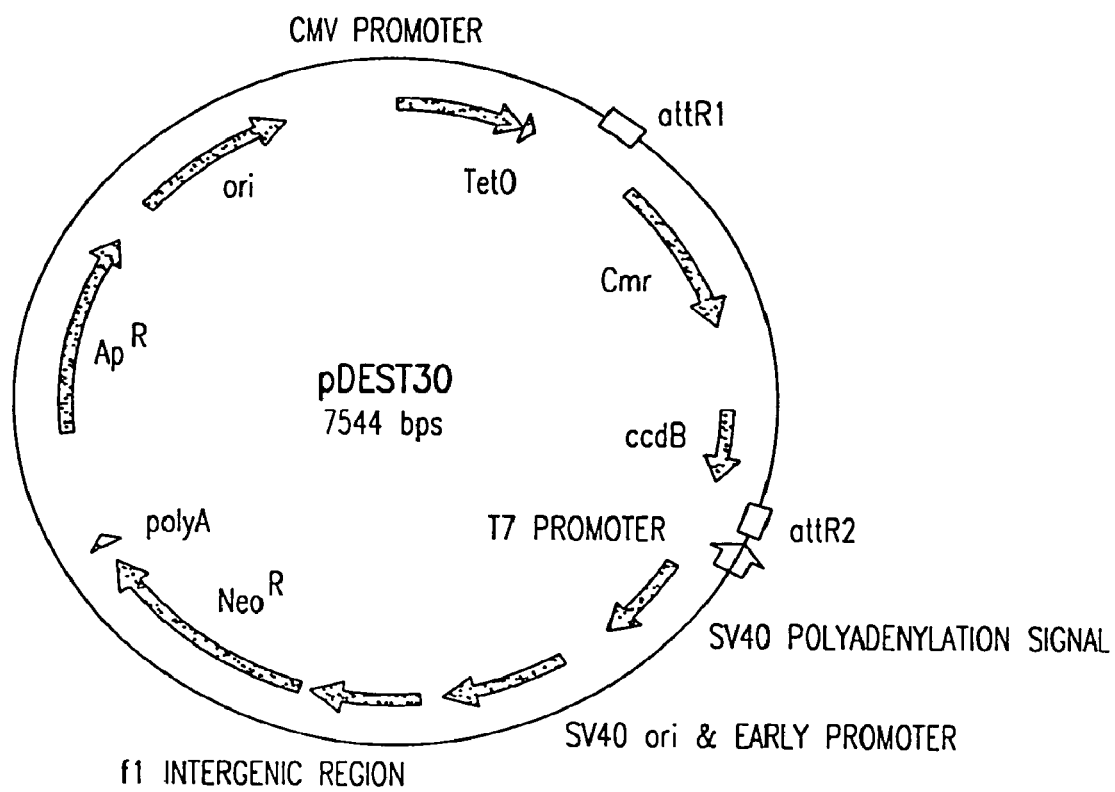
FIG. 92 is a schematic depiction of the physical map (FIG. 92A), and the nucleotide sequence (FIGS. 92B-D) (SEQ ID NO:177), of Destination Vector pDEST30.
Figure 93A:
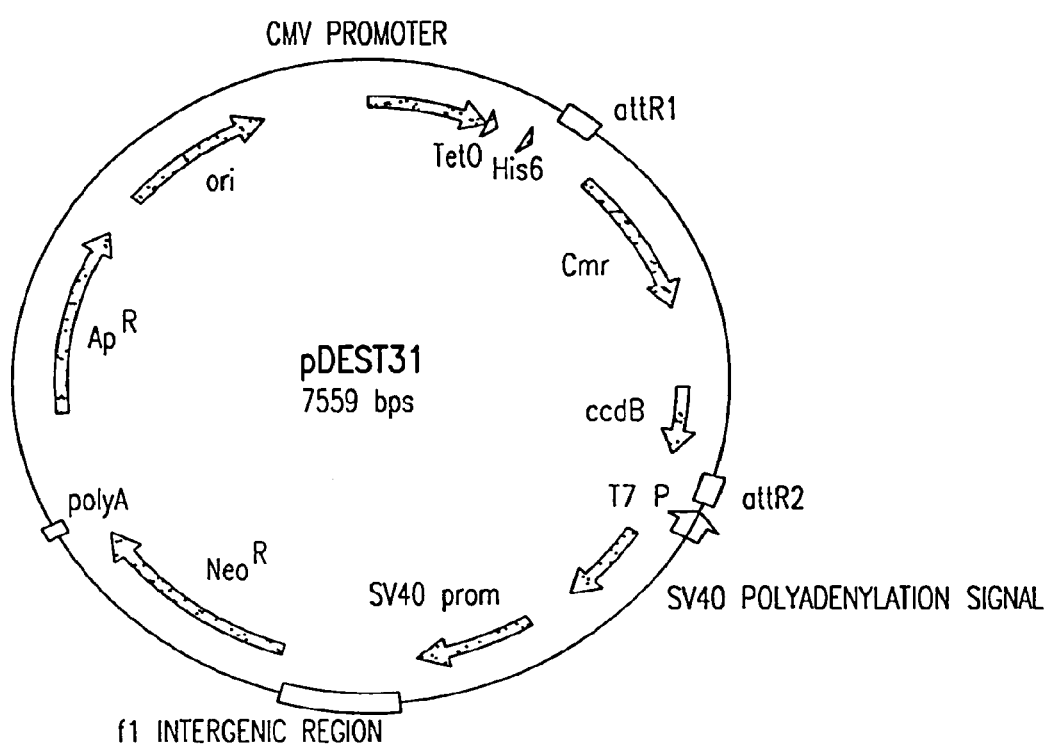
FIG. 93 is a schematic depiction of the physical map (FIG. 93A), and the nucleotide sequence (FIGS. 93B-D) (SEQ ID NO:178), of Destination Vector pDEST31.
Figure 94A:
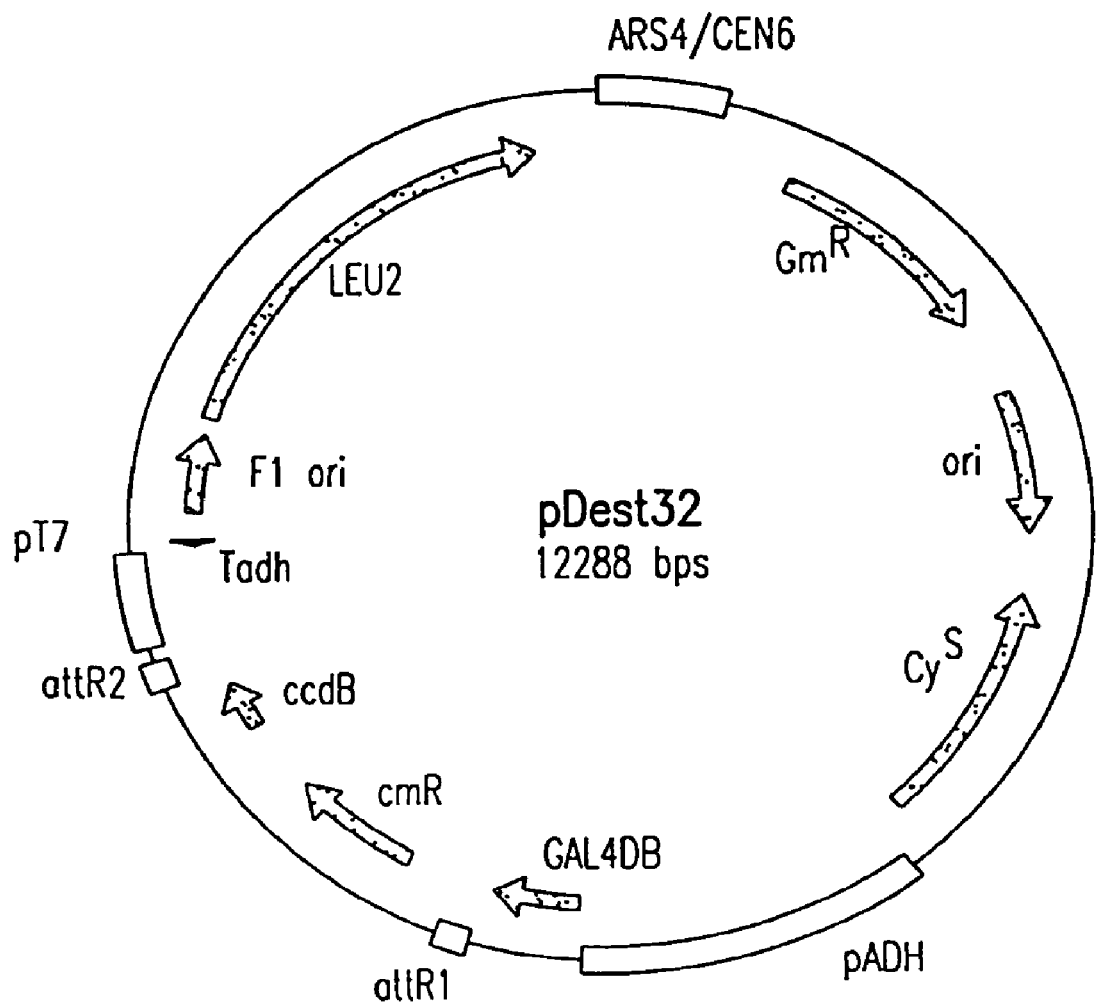
FIG. 94 is a schematic depiction of the physical map (FIG. 94A), and the nucleotide sequence (FIGS. 94B-E) (SEQ ID NO:179), of Destination Vector pDEST32.
Figure 95A:
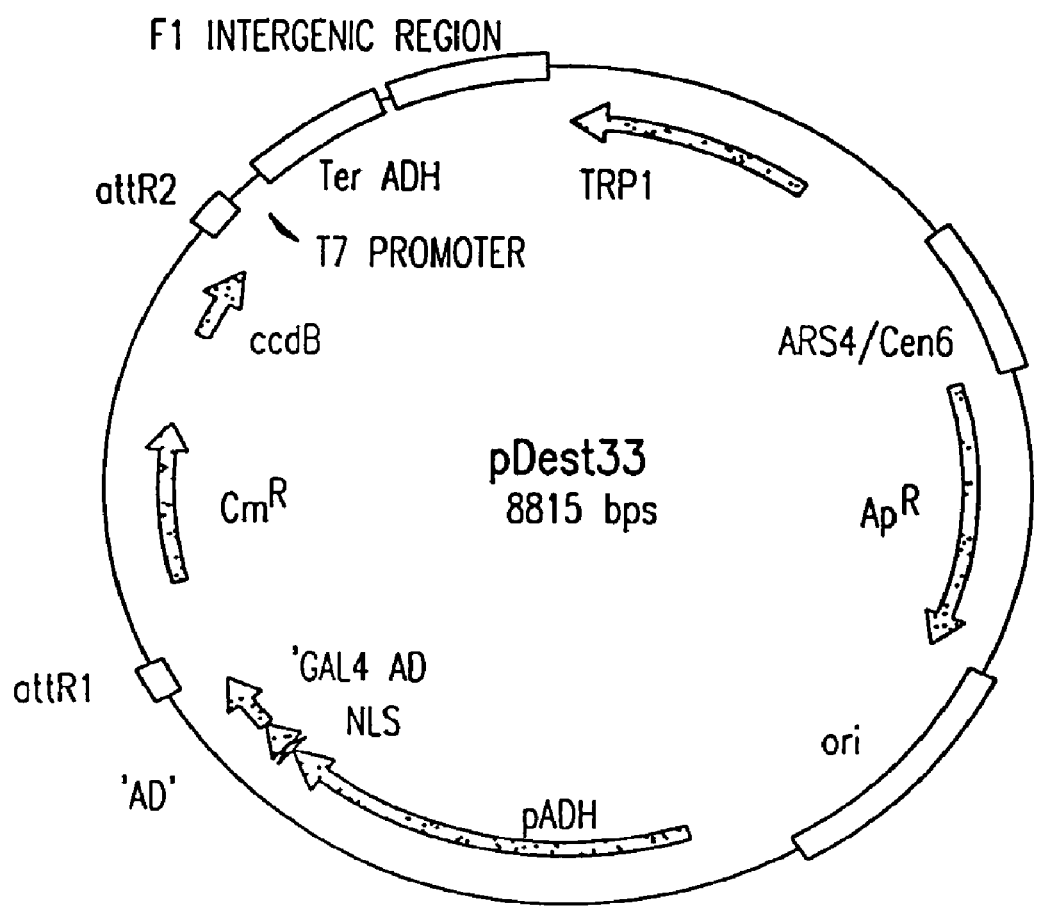
FIG. 95 is a schematic depiction of the physical map (FIG. 95A), and the nucleotide sequence (FIGS. 95B-D) (SEQ ID NO:180), of Destination Vector pDEST33.
Figure 96A:
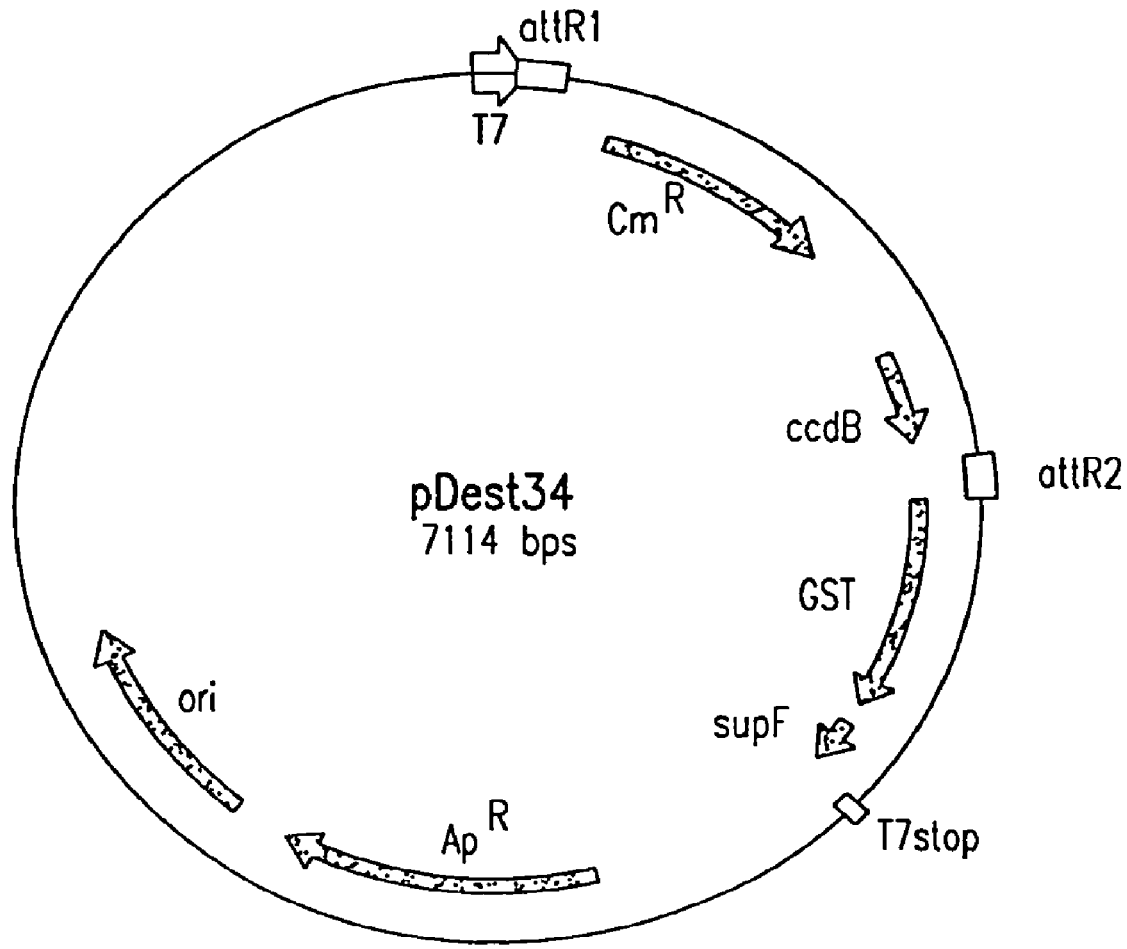
FIG. 96 is a schematic depiction of the physical map (FIG. 96A), and the nucleotide sequence (FIGS. 96B-D) (SEQ ID NO:181), of Destination Vector pDEST34.
Figure 97A:
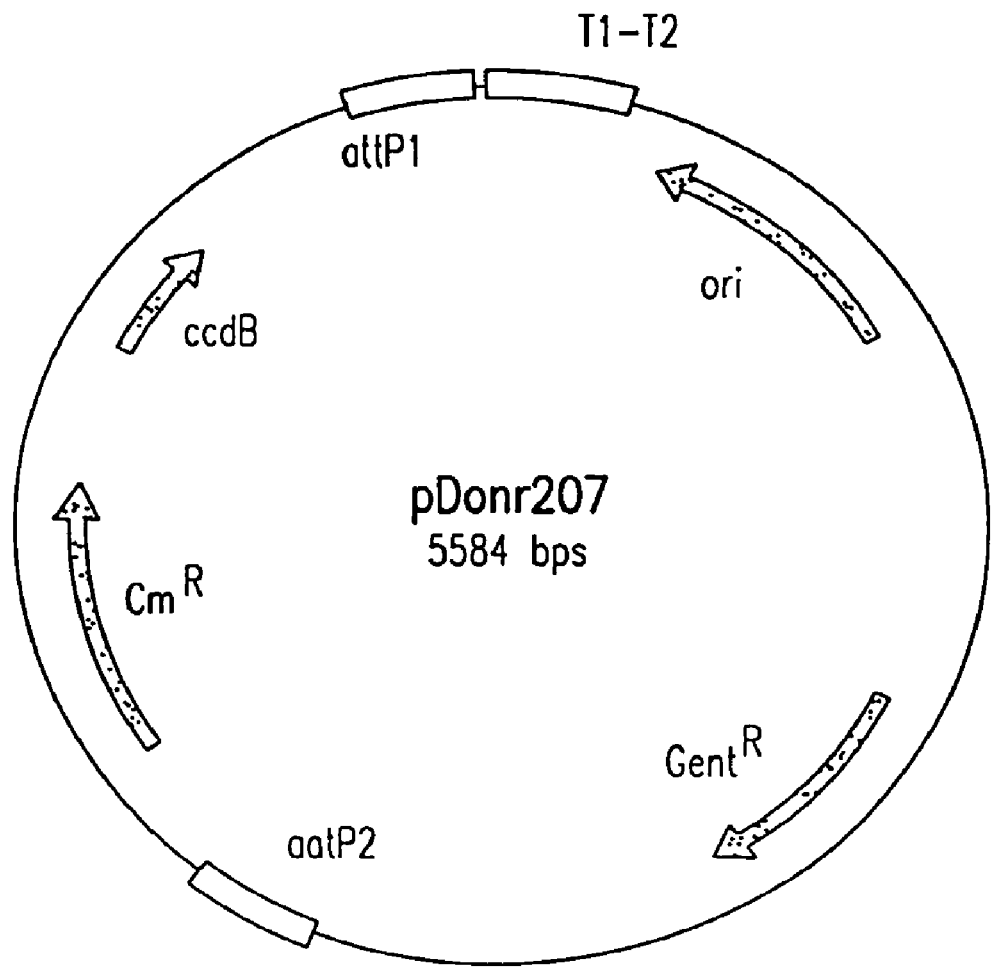
FIG. 97 is a depiction of the physical map (FIG. 97A), and the nucleotide sequence (FIGS. 97B-C) (SEQ ID NO:182), for the Donor plasmid pDONR207 which donates a gentamycin-resistant vector in the BP Reaction.
Figure 98A:
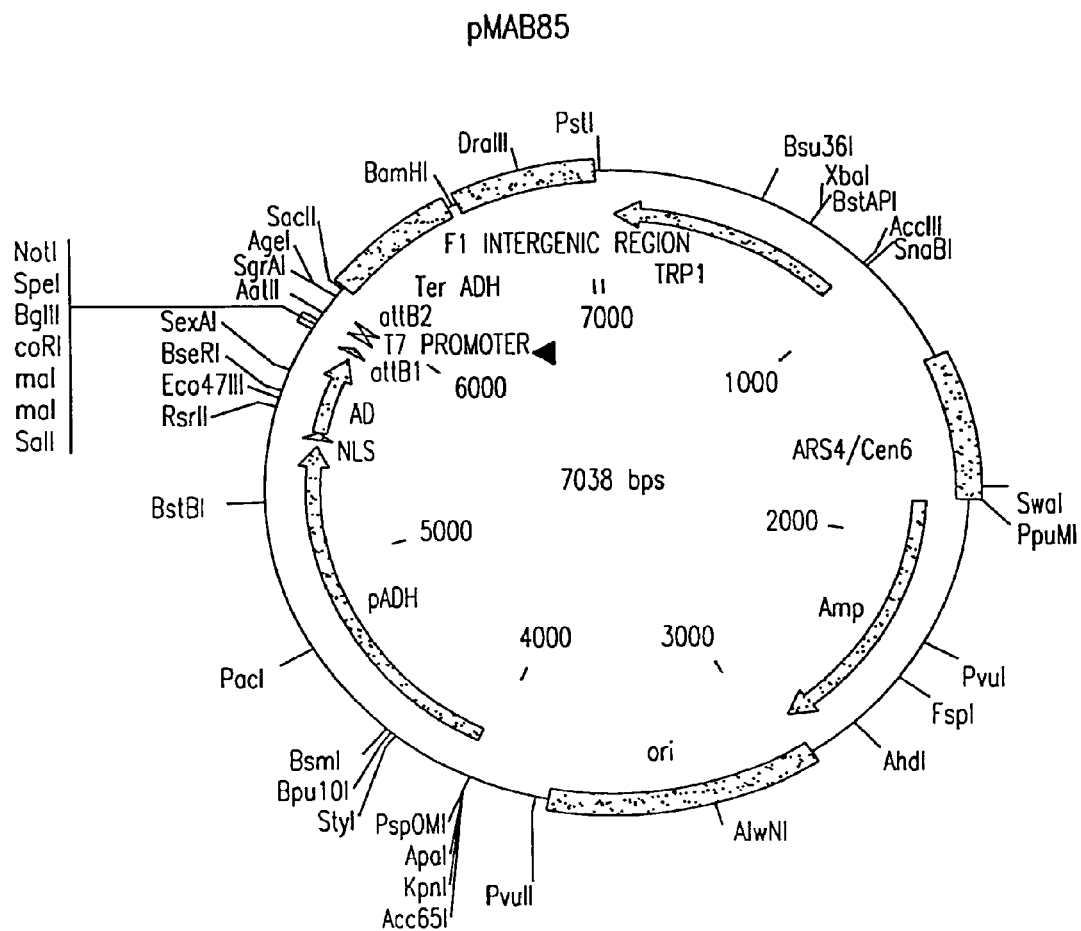
FIG. 98 is a schematic depiction of the physical map (FIG. 98A), and the nucleotide sequence (FIGS. 98B-D) (SEQ ID NO:183), of the 2-hybrid vector pMAB85.
Figure 99A:
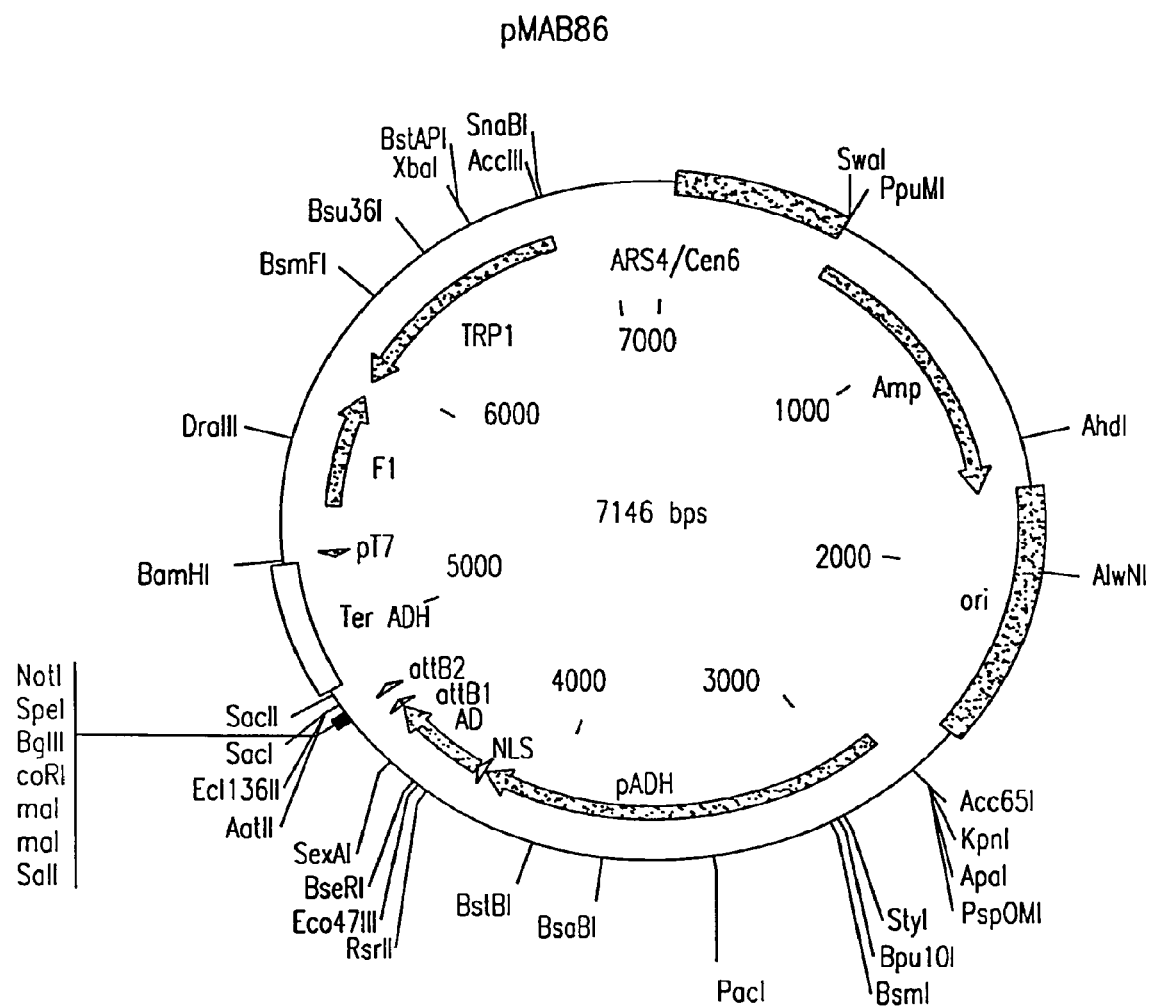
FIG. 99 is a schematic depiction of the physical map (FIG. 99A), and the nucleotide sequence (FIGS. 99B-D) (SEQ ID NO:184), of the 2-hybrid vector pMAB86.

Preferred vectors according to this aspect of the invention include, but are not limited to: pENTR1A (FIGS. 10A and 10B), pENTR2B (FIGS. 11A and 11B), pENTR3C (FIGS. 12A and 12B), pENTR4 (FIGS. 13A and 13B), pENTR5 (FIGS. 14A and 14B), pENTR6 (FIGS. 15A and 15B), pENTR7 (FIGS. 16A and 16B), pENTR8 (FIGS. 17A and 17B), pENTR9 (FIGS. 18A and 18B), pENTR10 (FIGS. 19A and 19B), pENTR11 (FIGS. 20A and 20B), pDEST1 (FIGS. 21A-D), pDEST2 (FIGS. 22A-D), pDEST3 (FIGS. 23A-D), pDEST4 (FIGS. 24A-D), pDEST5 (FIGS. 25A-D), pDEST6 (FIGS. 26A-D), pDEST7 (FIGS. 27A-C), pDEST8 (FIGS. 28A-D), pDEST9 (FIGS. 29A-E), pDEST10 (FIGS. 30A-D), pDEST11 (FIGS. 31A-D), pDEST12.2 (also known as pDEST12) (FIGS. 32A-D), pDEST13 (FIGS. 33A-C), pDEST14 (FIGS. 34A-D), pDEST15 (FIGS. 35A-D), pDEST16 (FIGS. 36A-D), pDEST17 (FIGS. 37A-D), pDEST18 (FIGS. 38A-D), pDEST19 (FIGS. 39A-D), pDEST20 (FIGS. 40A-D), pDEST21 (FIGS. 41A-E), pDEST22 (FIGS. 42A-D), pDEST23 (FIGS. 43A-D), pDEST24 (FIGS. 44A-D), pDEST25 (FIGS. 45A-D), pDEST26 (FIGS. 46A-D), pDEST27 (FIGS. 47A-D), pEXP501 (also known as pCMVSPORT6) (FIGS. 48A-B), pDONR201 (also known as pENTR21 attP vector or pAttP-kan Donor Vector) (FIG. 49), pDONR202 (FIG. 50), pDONR203 (also known as pEZ15812) (FIG. 51), pDONR204 (FIG. 52), pDONR205 (FIG. 53), pDONR206 (also known as pENTR22 attP vector or pAttPgen Donor Vector) (FIG. 54), pMAB58 (FIG. 87), pMAB62 (FIG. 88), pDEST28 (FIG. 90), pDEST29 (FIG. 91), pDEST30 (FIG. 92), pDEST31 (FIG. 93), pDEST32 (FIG. 94), pDEST33 (FIG. 95), pDEST34 (FIG. 96), pDONR207 (FIG. 97), pMAB85 (FIG. 98), pMAB86 (FIG. 99), and fragments, mutants, variants, and derivatives thereof. However, it will be understood by one of ordinary skill that the present invention also encompasses other vectors not specifically designated herein, which comprise one or more of the isolated nucleic acid molecules of the invention encoding one or more recombination sites or portions thereof (or mutants, fragments, variants or derivatives thereof), and which may further comprise one or more additional physical or functional nucleotide sequences described herein which may optionally be operably linked to the one or more nucleic acid molecules encoding one or more recombination sites or portions thereof. Such additional vectors may be produced by one of ordinary skill according to the guidance provided in the present specification.

Polymerases

Preferred polypeptides having reverse transcriptase activity (i.e., those polypeptides able to catalyze the synthesis of a DNA molecule from an RNA template) for use in accordance with the present invention include, but are not limited to Moloney Murine Leukemia Virus (M-MLV) reverse transcriptase, Rous Sarcoma Virus (RSV) reverse transcriptase, Avian Myeloblastosis Virus (AMV) reverse transcriptase, Rous Associated Virus (RAV) reverse transcriptase, Myeloblastosis Associated Virus (MAV) reverse transcriptase, Human Immunodeficiency Virus (HIV) reverse transcriptase, retroviral reverse transcriptase, retrotransposon reverse transcriptase, hepatitis B reverse transcriptase, cauliflower mosaic virus reverse transcriptase and bacterial reverse transcriptase. Particularly preferred are those polypeptides having reverse transcriptase activity that are also substantially reduced in RNAse H activity (i.e., "RNAse H$^-$" polypeptides). By a polypeptide that is "substantially reduced in RNase H activity" is meant that the polypeptide has less than about 20%, more preferably less than about 15%, 10% or 5%, and most preferably less than about 2%, of the RNase H activity of a wildtype or RNase H$^+$ enzyme such as wildtype M-MLV reverse transcriptase. The RNase H activity may be determined by a variety of assays, such as those described, for example, in U.S. Pat. No. 5,244,797, in Kotewicz, M. L. et al., *Nucl. Acids Res.* 16:265 (1988) and in Gerard, G. F., et al., *FOCUS* 14(5):91 (1992), the disclosures of all of which are fully incorporated herein by reference. Suitable RNAse H$^-$ polypeptides for use in the present invention include, but are not limited to, M-MLV H$^-$ reverse transcriptase, RSV H$^-$ reverse transcriptase, AMV H$^-$ reverse transcriptase, RAV H$^-$ reverse transcriptase, MAV H$^-$ reverse transcriptase, HIV H$^-$ reverse transcriptase, THERMOSCRIPT™ reverse transcriptase and THERMOSCRIPT™ II reverse transcriptase, and SUPERSCRIPT™ I reverse transcriptase and SUPERSCRIPT™ II reverse transcriptase, which are obtainable, for example, from Life Technologies, Inc. (Rockville, Md.). See generally published PCT application WO 98/47912.

Other polypeptides having nucleic acid polymerase activity suitable for use in the present methods include thermophilic DNA polymerases such as DNA polymerase I, DNA polymerase III, Klenow fragment, T7 polymerase, and T5 polymerase, and thermostable DNA polymerases including, but not limited to, *Thermus thermophilus* (Tth) DNA polymerase, *Thermus aquaticus* (Taq) DNA polymerase, *Thermotoga neopolitana* (Tne) DNA polymerase, *Thermotoga maritima* (Tma) DNA polymerase, *Thermococcus litoralis* (Tli or VENT®) DNA polymerase, *Pyrococcus furiosus* (Pfu) DNA polymerase, *Pyrococcus* species GB-D (or DEEPVENT®) DNA polymerase, *Pyrococcus woosii* (Pwo) DNA polymerase, *Bacillus sterothermophilus* (Bst) DNA polymerase, *Sulfolobus acidocaldarius* (Sac) DNA polymerase, *Thermoplasma acidophilum* (Tac) DNA polymerase, *Thermus flavus* (Tfl/Tub) DNA polymerase, *Thermus ruber* (Tru) DNA polymerase, *Thermus brockianus* (DYNAZYME®) DNA polymerase, *Methanobacterium thermoautotrophicum* (Mth) DNA polymerase, and mutants, variants and derivatives thereof. Such polypeptides are available commercially, for example from Life Technologies, Inc. (Rockville, Md.), New Englan BioLabs (Beverly, Mass.), and Sigma/Aldrich (St. Louis, Mo.).

Host Cells

The invention also relates to host cells comprising one or more of the nucleic acid molecules or vectors of the invention, particularly those nucleic acid molecules and vectors described in detail herein. Representative host cells that may be used according to this aspect of the invention include, but are not limited to, bacterial cells, yeast cells, plant cells and animal cells. Preferred bacterial host cells include *Escherichia* spp. cells (particularly *E. coli* cells and most particularly *E. coli* strains DH10B, Stb12, DH5α, DB3, DB3.1 (preferably *E. coli* LIBRARY EFFICIENCY® DB3.1™ Competent Cells; Life Technologies, Inc., Rockville, Md.), DB4 and DB5; see U.S. Provisional Application No. 60/122,392, filed on Mar. 2, 1999, the disclosure of which is incorporated by reference herein in its entirety), *Bacillus* spp. cells (particularly *B. subtilis* and *B. megaterium* cells), *Streptomyces* spp. cells, *Erwinia* spp. cells, *Klebsiella* spp. cells, *Serratia* spp. cells (particularly *S. marcessans* cells), *Pseudomonas* spp. cells (particularly *P. aeruginosa* cells), and *Salmonella* spp. cells (particularly *S. typhimurium* and *S. typhi* cells). Preferred animal host cells include insect cells (most particularly *Drosophila melanogaster* cells, *Spodoptera frugiperda* Sf9 and Sf21 cells and *Trichoplusa* High-Five cells), nematode cells (particularly *C. elegans* cells), avian cells, amphibian cells (particularly *Xenopus laevis* cells), reptilian cells, and mammalian cells (most particularly CHO, COS, VERO, BHK and human cells). Preferred yeast host cells include *Saccharomyces cerevisiae* cells and *Pichia pastoris* cells. These and other suitable host cells are available commercially, for example from Life Technologies, Inc. (Rockville, Md.), American Type Culture Collection (Manassas, Va.), and Agricultural Research Culture Collection (NRRL; Peoria, Ill.).

Methods for introducing the nucleic acid molecules and/or vectors of the invention into the host cells described herein, to produce host cells comprising one or more of the nucleic acid molecules and/or vectors of the invention, will be familiar to those of ordinary skill in the art. For instance, the nucleic acid molecules and/or vectors of the invention may be introduced into host cells using well known techniques of infection, transduction, transfection, and transformation. The nucleic acid molecules and/or vectors of the invention may be introduced alone or in conjunction with other the nucleic acid molecules and/or vectors. Alternatively, the nucleic acid molecules and/or vectors of the invention may be introduced into host cells as a precipitate, such as a calcium phosphate precipitate, or in a complex with a lipid. Electroporation also may be used to introduce the nucleic acid molecules and/or vectors of the invention into a host. Likewise, such molecules may be introduced into chemically competent cells such as *E. coli*. If the vector is a virus, it may be packaged in vitro or introduced into a packaging cell and the packaged virus may be transduced into cells. Hence, a wide variety of techniques suitable for introducing the nucleic acid molecules and/or vectors of the invention into cells in accordance with this aspect of the invention are well known and routine to those of skill in the art. Such techniques are reviewed at length, for example, in Sambrook, J., et al., *Molecular Cloning, a Laboratory Manual*, 2nd Ed., Cold Spring Harbor, N.Y.: Cold Spring Harbor Laboratory Press, pp. 16.30-16.55 (1989), Watson, J. D., et al., *Recombinant DNA, 2nd Ed.*, New York: W. H. Freeman and Co., pp. 213-234 (1992), and Winnacker, E.-L., *From Genes to Clones*, New York: VCH Publishers (1987), which are illustrative of the many laboratory manuals that detail these techniques and which are incorporated by reference herein in their entireties for their relevant disclosures.

Polypeptides

In another aspect, the invention relates to polypeptides encoded by the nucleic acid molecules of the invention (including polypeptides and amino acid sequences encoded by all possible reading frames of the nucleic acid molecules of the invention), and to methods of producing such polypeptides. Polypeptides of the present invention include purified or isolated natural products, products of chemical synthetic procedures, and products produced by recombinant techniques from a prokaryotic or eukaryotic host, including, for example, bacterial, yeast, insect, mammalian, avian and higher plant cells.

The polypeptides of the invention may be produced by synthetic organic chemistry, and are preferably produced by standard recombinant methods, employing one or more of the host cells of the invention comprising the vectors or isolated nucleic acid molecules of the invention. According to the invention, polypeptides are produced by cultivating the host cells of the invention (which comprise one or more of the nucleic acid molecules of the invention, preferably contained within an Expression Vector) under conditions favoring the expression of the nucleotide sequence contained on the nucleic acid molecule of the invention, such that the polypeptide encoded by the nucleic acid molecule of the invention is produced by the host cell. As used herein, "conditions favoring the expression of the nucleotide sequence" or "conditions favoring the production of a polypeptide" include optimal physical (e.g., temperature, humidity, etc.) and nutritional (e.g., culture medium, ionic) conditions required for production of a recombinant polypeptide by a given host cell. Such optimal conditions for a variety of host cells, including prokaryotic (bacterial), mammalian, insect, yeast, and plant cells will be familiar to one of ordinary skill in the art, and may be found, for example, in Sambrook, J., et al., *Molecular Cloning, A Laboratory Manual, 2nd Ed.*, Cold Spring Harbor, N.Y.: Cold Spring Harbor Laboratory Press, (1989), Watson, J. D., et al., *Recombinant DNA*, 2nd Ed., New York: W.H. Freeman and Co., and Winnacker, E.-L., *From Genes to Clones*, New York: VCH Publishers (1987).

In some aspects, it may be desirable to isolate or purify the polypeptides of the invention (e.g., for production of antibodies as described below), resulting in the production of the polypeptides of the invention in isolated form. The polypeptides of the invention can be recovered and purified from recombinant cell cultures by well-known methods of protein purification that are routine in the art, including ammonium sulfate or ethanol precipitation, acid extraction, anion or cation exchange chromatography, phosphocellulose chromatography, hydrophobic interaction chromatography, affinity chromatography, hydroxylapatite chromatography and lectin chromatography. For example, His6 or GST fusion tags on polypeptides made by the methods of the invention may be isolated using appropriate affinity chromatography matrices which bind polypeptides bearing His6 or GST tags, as will be familiar to one of ordinary skill in the art. Polypeptides of the present invention include naturally purified products, products of chemical synthetic procedures, and products produced by recombinant techniques from a prokaryotic or eukaryotic host, including, for example, bacterial, yeast, higher plant, insect and mammalian cells. Depending upon the host employed in a recombinant production procedure, the polypeptides of the present invention may be glycosylated or may be non-glycosylated. In addition, polypeptides of the invention may also include an initial modified methionine residue, in some cases as a result of host-mediated processes.

Isolated polypeptides of the invention include those comprising the amino acid sequences encoded by one or more of the reading frames of the polynucleotides comprising one or more of the recombination site-encoding nucleic acid molecules of the invention, including those encoding attB1, attB2, attP1, attP2, attL1, attL2, attR1 and attR2 having the nucleotide sequences set forth in FIG. 9 (or nucleotide sequences complementary thereto), or fragments, variants, mutants and derivatives thereof; the complete amino acid sequences encoded by the polynucleotides contained in the deposited clones described herein; the amino acid sequences encoded by polynucleotides which hybridize under stringent hybridization conditions to polynucleotides having the nucleotide sequences encoding the recombination site sequences of the invention as set forth in FIG. 9 (or a nucleotide sequence complementary thereto); or a peptide or polypeptide comprising a portion or a fragment of the above polypeptides. The invention also relates to additional polypeptides having one or more additional amino acids linked (typically by peptidyl bonds to form a nascent polypeptide) to the polypeptides encoded by the recombination site nucleotide sequences or the deposited clones. Such additional amino acid residues may comprise one or more functional peptide sequences, for example one or more fusion partner peptides (e.g., GST, $His_6$, Trx, etc.) and the like.

As used herein, the terms "protein," "peptide," "oligopeptide" and "polypeptide" are considered synonymous (as is commonly recognized) and each term can be used interchangeably as the context requires to indicate a chain of two or more amino acids, preferably five or more amino acids, or more preferably ten or more amino acids, coupled by (a) peptidyl linkage(s), unless otherwise defined in the specific contexts below. As is commonly recognized in the art, all polypeptide formulas or sequences herein are written from left to right and in the direction from amino terminus to carboxy terminus.

It will be recognized by those of ordinary skill in the art that some amino acid sequences of the polypeptides of the invention can be varied without significant effect on the structure or function of the polypeptides. If such differences in sequence are contemplated, it should be remembered that there will be critical areas on the protein which determine structure and activity. In general, it is possible to replace residues which form the tertiary structure, provided that residues performing a similar function are used. In other instances, the type of residue may be completely unimportant if the alteration occurs at a non-critical region of the polypeptide.

Thus, the invention further includes variants of the polypeptides of the invention, including allelic variants, which show substantial structural homology to the polypeptides described herein, or which include specific regions of these polypeptides such as the portions discussed below. Such mutants may include deletions, insertions, inversions, repeats, and type substitutions (for example, substituting one hydrophilic residue for another, but not strongly hydrophilic for strongly hydrophobic as a rule). Small changes or such "neutral" or "conservative" amino acid substitutions will generally have little effect on activity.

Typical conservative substitutions are the replacements, one for another, among the aliphatic amino acids Ala, Val, Leu and Ile; interchange of the hydroxylated residues Ser and Thr; exchange of the acidic residues Asp and Glu; substitution between the amidated residues Asn and Gln; exchange of the basic residues Lys and Arg; and replacements among the aromatic residues Phe and Tyr.

Thus, the fragment, derivative or analog of the polypeptides of the invention, such as those comprising peptides encoded by the recombination site nucleotide sequences described herein, may be (i) one in which one or more of the amino acid residues are substituted with a conservative or non-conservative amino acid residue (preferably a conservative amino acid residue), and such substituted amino acid residue may be encoded by the genetic code or may be an amino acid (e.g., desmosine, citrulline, ornithine, etc.) that is not encoded by the genetic code; (ii) one in which one or more of the amino acid residues includes a substituent group (e.g., a phosphate, hydroxyl, sulfate or other group) in addition to the normal "R" group of the amino acid; (iii) one in which the mature polypeptide is fused with another compound, such as a compound to increase the half-life of the polypeptide (for example, polyethylene glycol), or (iv) one in which additional amino acids are fused to the mature polypeptide, such as an immunoglobulin Fc region peptide, a leader or secretory sequence, a sequence which is employed for purification of the mature polypeptide (such as GST) or a proprotein sequence. Such fragments, derivatives and analogs are intended to be encompassed by the present invention, and are within the scope of those skilled in the art from the teachings herein and the state of the art at the time of invention.

The polypeptides of the present invention are preferably provided in an isolated form, and preferably are substantially purified. Recombinantly produced versions of the polypeptides of the invention can be substantially purified by the one-step method described in Smith and Johnson, *Gene* 67:31-40 (1988). As used herein, the term "substantially purified" means a preparation of an individual polypeptide of the invention wherein at least 50%, preferably at least 60%, 70%, or 75% and more preferably at least 80%, 85%, 90%, 91%, 92%, 93%, 94%, 95%, 96%, 97%, 98% or 99% (by mass) of contaminating proteins (i.e., those that are not the individual polypeptides described herein or fragments, variants, mutants or derivatives thereof) have been removed from the preparation.

The polypeptides of the present invention include those which are at least about 50% identical, at least 60% identical, at least 65% identical, more preferably at least about 70%, at least about 75%, at least about 80%, at least about 85%, at least about 90%, at least about 95%, at least about 96%, at least about 97%, at least about 98% or at least about 99% identical, to the polypeptides described herein. For example, preferred attB1-containing polypeptides of the invention include those that are at least about 50% identical, at least 60% identical, at least 65% identical, more preferably at least about 70%, at least about 75%, at least about 80%, at least about 85%, at least about 90%, at least about 95%, at least about 96%, at least about 97%, at least about 98% or at least about 99% identical, to the polypeptide(s) encoded by the three reading frames of a polynucleotide comprising a nucleotide sequence of attB1 having a nucleic acid sequence as set forth in FIG. 9 (or a nucleic acid sequence complementary thereto), to a polypeptide encoded by a polynucleotide contained in the deposited cDNA clones described herein, or to a polypeptide encoded by a polynucleotide hybridizing under stringent conditions to a polynucleotide comprising a nucleotide sequence of attB1 having a nucleic acid sequence as set forth in FIG. 9 (or a nucleic acid sequence complementary thereto). Analogous polypeptides may be prepared that are at least about 65% identical, more preferably at least about 70%, at least about 75%, at least about 80%, at least about 85%, at least about 90%, at least about 95%, at least about 96%, at least about 97%, at least about 98% or at least about 99% identical, to the attB2, attP1, attP2, attL1, attL2, attR1 and attR2 polypeptides of the invention as depicted in FIG. 9. The present polypeptides also include portions or fragments of the above-described polypeptides with at least 5, 10, 15, 20, or 25 amino acids.

By a polypeptide having an amino acid sequence at least, for example, 65% "identical" to a reference amino acid sequence of a given polypeptide of the invention is intended that the amino acid sequence of the polypeptide is identical to the reference sequence except that the polypeptide sequence may include up to 35 amino acid alterations per each 100 amino acids of the reference amino acid sequence of a given polypeptide of the invention. In other words, to obtain a polypeptide having an amino acid sequence at least 65% identical to a reference amino acid sequence, up to 35% of the amino acid residues in the reference sequence may be deleted or substituted with another amino acid, or a number of amino acids up to 35% of the total amino acid residues in the reference sequence may be inserted into the reference sequence. These alterations of the reference sequence may occur at the amino (N-) or carboxy (C-) terminal positions of the reference amino acid sequence or anywhere between those terminal positions, interspersed either individually among residues in the reference sequence or in one or more contiguous groups within the reference sequence. As a practical matter, whether a given amino acid sequence is, for example, at least 65% identical to the amino acid sequence of a given polypeptide of the invention can be determined conventionally using known computer programs such as those described above for nucleic acid sequence identity determinations, or more preferably using the CLUSTAL W program (Thompson, J. D., et al., *Nucleic Acids Res.* 22:4673-4680 (1994)).

The polypeptides of the present invention can be used as molecular weight markers on SDS-PAGE gels or on molecular sieve gel filtration columns using methods well known to those of skill in the art. In addition, as described in detail below, the polypeptides of the present invention can be used to raise polyclonal and monoclonal antibodies which are useful in a variety of assays for detecting protein expression, localization, detection of interactions with other molecules, or for the isolation of a polypeptide (including a fusion polypeptide) of the invention.

In another aspect, the present invention provides a peptide or polypeptide comprising an epitope-bearing portion of a polypeptide of the invention, which may be used to raise antibodies, particularly monoclonal antibodies, that bind specifically to a one or more of the polypeptides of the invention. The epitope of this polypeptide portion is an immunogenic or antigenic epitope of a polypeptide of the invention. An "immunogenic epitope" is defined as a part of a protein that elicits an antibody response when the whole protein is the immunogen. These immunogenic epitopes are believed to be confined to a few loci on the molecule. On the other hand, a region of a protein molecule to which an antibody can bind is defined as an "antigenic epitope." The number of immunogenic epitopes of a protein generally is less than the number of antigenic epitopes (see, e.g., Geysen et al., *Proc. Natl. Acad. Sci. USA* 81:3998-4002 (1983)).

As to the selection of peptides or polypeptides bearing an antigenic epitope (i.e., that contain a region of a protein molecule to which an antibody can bind), it is well-known in the art that relatively short synthetic peptides that mimic part of a protein sequence are routinely capable of eliciting an antiserum that reacts with the partially mimicked protein (see, e.g., Sutcliffe, J. G., et al., *Science* 219:660-666 (1983)). Peptides capable of eliciting protein-reactive sera are frequently represented in the primary sequence of a protein, can be characterized by a set of simple chemical rules, and are not confined to the immunodominant regions of intact proteins (i.e., immunogenic epitopes) or to the amino or carboxy termini. Peptides that are extremely hydrophobic and those of six or fewer residues generally are ineffective at inducing antibodies that bind to the mimicked protein; longer peptides, especially those containing proline residues, usually are effective (Sutcliffe, J. G., et al., *Science* 219:660-666 (1983)).

Epitope-bearing peptides and polypeptides of the invention designed according to the above guidelines preferably contain a sequence of at least five, more preferably at least seven or more amino acids contained within the amino acid sequence of a polypeptide of the invention. However, peptides or polypeptides comprising a larger portion of an amino acid sequence of a polypeptide of the invention, containing about 30 to about 50 amino acids, or any length up to and including the entire amino acid sequence of a given polypeptide of the invention, also are considered epitope-bearing peptides or polypeptides of the invention and also are useful for inducing antibodies that react with the mimicked protein. Preferably, the amino acid sequence of the epitope-bearing peptide is selected to provide substantial solubility in aqueous solvents (i.e., the sequence includes relatively hydrophilic residues and highly hydrophobic sequences are preferably avoided); sequences containing proline residues are particularly preferred.

Non-limiting examples of epitope-bearing polypeptides or peptides that can be used to generate antibodies specific for the polypeptides of the invention include certain epitope-bearing regions of the polypeptides comprising amino acid sequences encoded by polynucleotides comprising one or more of the recombination site-encoding nucleic acid molecules of the invention, including those encoding attB1, attB2, attP1, attP2, attL1, attL2, attR1 and attR2 having the nucleotide sequences set forth in FIG. 9 (or a nucleotide sequence complementary thereto); the complete amino acid sequences encoded by the three reading frames of the polynucleotides contained in the deposited clones described herein; and the amino acid sequences encoded by all reading frames of polynucleotides which hybridize under stringent hybridization conditions to polynucleotides having the nucleotide sequences encoding the recombination site sequences (or portions thereof) of the invention as set forth in FIG. 9 (or a nucleic acid sequence complementary thereto). Other epitope-bearing polypeptides or peptides that may be used to generate antibodies specific for the polypeptides of the invention will be apparent to one of ordinary skill in the art based on the primary amino acid sequences of the polypeptides of the invention described herein, via the construction of Kyte-Doolittle hydrophilicity and Jameson-Wolf antigenic index plots of the polypeptides of the invention using, for example, PROTEAN computer software (DNASTAR, Inc.; Madison, Wis.).

The epitope-bearing peptides and polypeptides of the invention may be produced by any conventional means for making peptides or polypeptides including recombinant means using nucleic acid molecules of the invention. For instance, a short epitope-bearing amino acid sequence may be fused to a larger polypeptide which acts as a carrier during recombinant production and purification, as well as during immunization to produce anti-peptide antibodies. Epitope-bearing peptides also may be synthesized using known methods of chemical synthesis (see, e.g., U.S. Pat. No. 4,631,211 and Houghten, R. A., *Proc. Natl. Acad. Sci. USA* 82:5131-5135 (1985), both of which are incorporated by reference herein in their entireties).

As one of skill in the art will appreciate, the polypeptides of the present invention and epitope-bearing fragments thereof may be immobilized onto a solid support, by techniques that are well-known and routine in the art. By "solid support" is intended any solid support to which a peptide can be immobilized. Such solid supports include, but are not limited to nitrocellulose, diazocellulose, glass, polystyrene, polyvinylchloride, polypropylene, polyethylene, dextran, Sepharose, agar, starch, nylon, beads and microtitre plates. Linkage of the peptide of the invention to a solid support can be accomplished by attaching one or both ends of the peptide to the support. Attachment may also be made at one or more internal sites in the peptide. Multiple attachments (both internal and at the ends of the peptide) may also be used according to the invention. Attachment can be via an amino acid linkage group such as a primary amino group, a carboxyl group, or a sulfhydryl (SH) group or by chemical linkage groups such as with cyanogen bromide (CNBr) linkage through a spacer. For non-covalent attachments to the support, addition of an affinity tag sequence to the peptide can be used such as GST (Smith, D. B., and Johnson, K. S., *Gene* 67:31 (1988)), polyhistidines (Hochuli, E., et al., *J. Chromatog.* 411:77 (1987)), or biotin. Such affinity tags may be used for the reversible attachment of the peptide to the support. Such immobilized polypeptides or fragments may be useful, for example, in isolating antibodies directed against one or more of the polypeptides of the invention, or other proteins or peptides that recognize other proteins or peptides that bind to one or more of the polypeptides of the invention, as described below.

As one of skill in the art will also appreciate, the polypeptides of the present invention and the epitope-bearing fragments thereof described herein can be combined with one or more fusion partner proteins or peptides, or portions thereof, including but not limited to GST, His$_6$, Trx, and portions of the constant domain of immunoglobulins (Ig), resulting in chimeric or fusion polypeptides. These fusion polypeptides facilitate purification of the polypeptides of the invention (EP 0 394 827; Traunecker et al., *Nature* 331:84-86 (1988)) for use in analytical or diagnostic (including high-throughput) format.

Antibodies

In another aspect, the invention relates to antibodies that recognize and bind to the polypeptides (or epitope-bearing fragments thereof) or nucleic acid molecules (or portions thereof) of the invention. In a related aspect, the invention relates to antibodies that recognize and bind to one or more polypeptides encoded by all reading frames of one or more recombination site nucleic acid sequences or portions thereof, or to one or more nucleic acid molecules comprising one or more recombination site nucleic acid sequences or portions thereof, including but not limited to att sites (including attB1, attB2, attP1, attP2, attL1, attL2, attR1, attR2 and the like), lox sites (e.g., loxP, loxP511, and the like), FRT, and the like, or mutants, fragments, variants and derivatives thereof. See generally U.S. Pat. No. 5,888,732, which is incorporated herein by reference in its entirety. The antibodies of the present invention may be polyclonal or monoclonal, and may be prepared by any of a variety of methods and in a variety of species according to methods that are well-known in the art. See, for instance, U.S. Pat. No. 5,587,287; Sutcliffe, J. G., et al., *Science* 219:660-666 (1983); Wilson et al., *Cell* 37: 767 (1984); and Bittle, F. J., et al., *J. Gen. Virol.* 66:2347-2354 (1985). Antibodies specific for any of the polypeptides or nucleic acid molecules described herein, such as antibodies specifically binding to one or more of the polypeptides encoded by the recombination site nucleotide sequences, or one or more nucleic acid molecules, described herein or contained in the deposited clones, antibodies against fusion polypeptides (e.g., binding to fusion polypeptides between one or more of the fusion partner proteins and one or more of the recombination site polypeptides of the invention, as described herein), and the like, can be raised against the intact polypeptides or polynucleotides of the invention or one or more antigenic polypeptide fragments thereof.

As used herein, the term "antibody" (Ab) may be used interchangeably with the terms "polyclonal antibody" or "monoclonal antibody" (mAb), except in specific contexts as described below. These terms, as used herein, are meant to include intact molecules as well as antibody fragments (such as, for example, Fab and $F(ab')_2$ fragments) which are capable of specifically binding to a polypeptide or nucleic acid molecule of the invention or a portion thereof. It will therefore be appreciated that, in addition to the intact antibodies of the invention, Fab, $F(ab')_2$ and other fragments of the antibodies described herein, and other peptides and peptide fragments that bind one or more polypeptides or polynucleotides of the invention, are also encompassed within the scope of the invention. Such antibody fragments are typically produced by proteolytic cleavage of intact antibodies, using enzymes such as papain (to produce Fab fragments) or pepsin (to produce $F(ab')_2$ fragments). Antibody fragments, and peptides or peptide fragments, may also be produced through the application of recombinant DNA technology or through synthetic chemistry.

Epitope-bearing peptides and polypeptides, and nucleic acid molecules or portions thereof, of the invention may be used to induce antibodies according to methods well known in the art, as generally described herein (see, e.g., Sutcliffe, et al., supra; Wilson, et al., supra; and Bittle, F. J., et al., *J. Gen. Virol.* 66:2347-2354 (1985)).

Polyclonal antibodies according to this aspect of the invention may be made by immunizing an animal with one or more of the polypeptides or nucleic acid molecules of the invention described herein or portions thereof according to standard techniques (see, e.g., Harlow, E., and Lane, D., *Antibodies: A Laboratory Manual*, Cold Spring Harbor, N.Y.: Cold Spring Harbor Laboratory Press (1988); Kaufman, P. B., et al., In: *Handbook of Molecular and Cellular Methods in Biology and Medicine*, Boca Raton, Fla.: CRC Press, pp. 468-469 (1995)). For producing antibodies that recognize and bind to the polypeptides or nucleic acid molecules of the invention or portions thereof, animals may be immunized with free peptide or free nucleic acid molecules; however, antibody titer may be boosted by coupling of the peptide to a macromolecular carrier, such as albumin, KLH, or tetanus toxoid (particularly for producing antibodies against the nucleic acid molecules of the invention or portions thereof; see Harlow and Lane, supra, at page 154), or to a solid phase carrier such as a latex or glass microbead. For instance, peptides containing cysteine may be coupled to carrier using a linker such as m-maleimidobenzoyl-N-hydroxysuccinimide ester (MBS), while other peptides may be coupled to carrier using a more general linking agent such as glutaraldehyde. Animals such as rabbits, rats and mice may be immunized with either free (if the polypeptide immunogen is larger than about 25 amino acids in length) or carrier-coupled peptides or nucleic acid molecules, for instance, by intraperitoneal and/or intradermal injection of emulsions containing about 100 μg peptide, polynucleotide, or carrier protein, and Freund's adjuvant. Several booster injections may be needed, for instance, at intervals of about two weeks, to provide a useful titer of antibody which can be detected, for example, by ELISA assay using free peptide or nucleic acid molecule adsorbed to a solid surface. In another approach, cells expressing one or more of the polypeptides or polynucleotides of the invention or an antigenic fragment thereof can be administered to an animal in order to induce the production of sera containing polyclonal antibodies, according to routine immunological methods. In yet another method, a preparation of one or more of the polypeptides or polynucleotides of the invention is prepared and purified as described herein, to render it substantially free of natural contaminants. Such a preparation may then be introduced into an animal in order to produce polyclonal antisera of greater specific activity. The titer of antibodies in serum from an immunized animal, regardless of the method of immunization used, may be increased by selection of anti-peptide or anti-polynucleotide antibodies, for instance, by adsorption to the peptide or polynucleotide on a solid support and elution of the selected antibodies according to methods well known in the art.

In an alternative method, the antibodies of the present invention are monoclonal antibodies (or fragments thereof which bind to one or more of the polypeptides of the invention). Such monoclonal antibodies can be prepared using hybridoma technology (Kohler et al., *Nature* 256:495 (1975); Köhler et al., *Eur. J. Immunol.* 6:511 (1976); Köhler et al., *Eur. J. Immunol.* 6:292 (1976); Hammerling et al., In: *Monoclonal Antibodies and T-Cell Hybridomas*, Elsevier, N.Y., pp. 563-681 (1981)). In general, such procedures involve immunizing an animal (preferably a mouse) with a polypeptide or polynucleotide of the invention (or a fragment thereof), or with a cell expressing a polypeptide or polynucleotide of the invention (or a fragment thereof). The splenocytes of such mice are extracted and fused with a suitable myeloma cell line. Any suitable myeloma cell line may be employed in accordance with the present invention; however, it is preferable to employ the parent myeloma cell line ($SP_2O$), available from the American Type Culture Collection, Rockville, Md. After fusion, the resulting hybridoma cells are selectively maintained in HAT medium, and then cloned by limiting dilution as described by Wands et al. (*Gastroenterol.* 80:225-232 (1981)). The hybridoma cells obtained through such a selection are then assayed to identify clones which secrete antibodies capable of binding one or more of the polypeptides or nucleic acid molecules of the invention, or fragments thereof. Hence, the present invention also provides hybridoma cells and cell lines producing monoclonal antibodies of the invention, particularly that recognize and bind to one or more of the polypeptides or nucleic acid molecules of the invention.

Alternatively, additional antibodies capable of binding to one or more of the polypeptides of the invention, or fragments thereof, may be produced in a two-step procedure through the use of anti-idiotypic antibodies. Such a method makes use of the fact that antibodies are themselves antigens, and that, therefore, it is possible to obtain an antibody which binds to a second antibody. In accordance with this method, antibodies specific for one or more of the polypeptides or polynucleotides of the invention, prepared as described above, are used to immunize an animal, preferably a mouse. The splenocytes of such an animal are then used to produce hybridoma cells, and the hybridoma cells are screened to identify clones which produce an antibody whose ability to bind to an antibody specific for one or more of the polypeptides or polynucleotides of the invention can be blocked by polypeptides of the invention themselves. Such antibodies comprise anti-idiotypic antibodies to the antibodies recognizing one or more of the polypeptides or polynucleotides of the invention, and can be used to immunize an animal to induce formation of further antibodies specific for one or more of the polypeptides or polynucleotides of the invention.

For use, the antibodies of the invention may optionally be detectably labeled by covalent or non-covalent attachment of one or more labels, including but not limited to chromogenic, enzymatic, radioisotopic, isotopic, fluorescent, toxic, chemiluminescent, or nuclear magnetic resonance contrast agents or other labels.

Examples of suitable enzyme labels include malate dehydrogenase, staphylococcal nuclease, delta-5-steroid isomerase, yeast-alcohol dehydrogenase, alpha-glycerol phosphate dehydrogenase, triose phosphate isomerase, peroxidase, alkaline phosphatase, asparaginase, glucose oxidase, beta-galactosidase, ribonuclease, urease, catalase, glucose-6-phosphate dehydrogenase, glucoamylase, and acetylcholine esterase.

Examples of suitable radioisotopic labels include $^{3}$H, $^{111}$In, $^{125}$I, $^{131}$I, $^{32}$P, $^{35}$S, $^{14}$C, $^{51}$Cr, $^{57}$To, $^{58}$Co, $^{59}$Fe, $^{75}$Se, $^{152}$Eu, $^{90}$Y, $^{67}$Cu, $^{217}$Ci, $^{211}$At, $^{212}$Pb, $^{47}$Sc, $^{109}$Pd, etc. $^{111}$In is a preferred isotope where in vivo imaging is used since its avoids the problem of dehalogenation of the $^{125}$I or $^{131}$I-labeled monoclonal antibody by the liver. In addition, this radionucleotide has a more favorable gamma emission energy for imaging (Perkins et al., *Eur. J. Nucl. Med.* 10:296-301 (1985); Carasquillo et al., *J. Nucl. Med.* 28:281-287 (1987)). For example, $^{111}$In coupled to monoclonal antibodies with 1-(P-isothiocyanatobenzyl)-DPTA has shown little uptake in non-tumorous tissues, particularly the liver, and therefore enhances specificity of tumor localization (Esteban et al., *J. Nucl. Med.* 28:861-870 (1987)).

Examples of suitable non-radioactive isotopic labels include $^{157}$Gd, $^{55}$Mn, $^{162}$Dy, $^{52}$Tr, and $^{56}$Fe.

Examples of suitable fluorescent labels include an $^{152}$Eu label, a fluorescein label, an isothiocyanate label, a rhodamine label, a phycoerythrin label, a phycocyanin label, an allophycocyanin label, an o-phthaldehyde label, a green fluorescent protein (GFP) label, and a fluorescamine label.

Examples of suitable toxin labels include diphtheria toxin, ricin, and cholera toxin.

Examples of chemiluminescent labels include a luminal label, an isoluminal label, an aromatic acridinium ester label, an imidazole label, an acridinium salt label, an oxalate ester label, a luciferin label, a luciferase label, and an aequorin label.

Examples of nuclear magnetic resonance contrasting agents include heavy metal nuclei such as Gd, Mn, and iron.

Typical techniques for binding the above-described labels to the antibodies of the invention are provided by Kennedy et al., *Clin. Chim. Acta* 70:1-31 (1976), and Schurs et al., *Clin. Chim. Acta* 81:1-40 (1977). Coupling techniques mentioned in the latter are the glutaraldehyde method, the periodate method, the dimaleimide method, the m-maleimidobenzyl-N-hydroxy-succinimide ester method, all of which methods are incorporated by reference herein.

It will be appreciated by one of ordinary skill that the antibodies of the present invention may alternatively be coupled to a solid support, to facilitate, for example, chromatographic and other immunological procedures using such solid phase-immobilized antibodies. Included among such procedures are the use of the antibodies of the invention to isolate or purify polypeptides comprising one or more epitopes encoded by the nucleic acid molecules of the invention (which may be fusion polypeptides or other polypeptides of the invention described herein), or to isolate or purify polynucleotides comprising one or more recombination site sequences of the invention or portions thereof. Methods for isolation and purification of polypeptides (and, by analogy, polynucleotides) by affinity chromatography, for example using the antibodies of the invention coupled to a solid phase support, are well-known in the art and will be familiar to one of ordinary skill. The antibodies of the invention may also be used in other applications, for example to cross-link or couple two or more proteins, polypeptides, polynucleotides, or portions thereof into a structural and/or functional complex. In one such use, an antibody of the invention may have two or more distinct epitope-binding regions that may bind, for example, a first polypeptide (which may be a polypeptide of the invention) at one epitope-binding region on the antibody and a second polypeptide (which may be a polypeptide of the invention) at a second epitope-binding region on the antibody, thereby bringing the first and second polypeptides into close proximity to each other such that the first and second polypeptides are able to interact structurally and/or functionally (as, for example, linking an enzyme and its substrate to carry out enzymatic catalysis, or linking an effector molecule and its receptor to carry out or induce a specific binding of the effector molecule to the receptor or a response to the effector molecule mediated by the receptor). Additional applications for the antibodies of the invention include, for example, the preparation of large-scale arrays of the antibodies, polypeptides, or nucleic acid molecules of the invention, or portions thereof, on a solid support, for example to facilitate high-throughput screening of protein or RNA expression by host cells containing nucleic acid molecules of the invention (known in the art as "chip array" protocols; see, e.g., U.S. Pat. Nos. 5,856,101, 5,837,832, 5,770,456, 5,744,305, 5,631,734, and 5,593,839, which are directed to production and use of chip arrays of polypeptides (including antibodies) and polynucleotides, and the disclosures of which are incorporated herein by reference in their entireties). By "solid support" is intended any solid support to which an antibody can be immobilized. Such solid supports include, but are not limited to nitrocellulose, diazocellulose, glass, polystyrene, polyvinylchloride, polycarbonate, polypropylene, polyethylene, dextran, Sepharose, agar, starch, nylon, beads and microtitre plates. Preferred are beads made of glass, latex or a magnetic material. Linkage of an antibody of the invention to a solid support can be accomplished by attaching one or both ends of the antibody to the support. Attachment may also be made at one or more internal sites in the antibody. Multiple attachments (both internal and at the ends of the antibody) may also be used according to the invention. Attachment can be via an amino acid linkage group such as a primary amino group, a carboxyl group, or a sulfhydryl (SH) group or by chemical linkage groups such as with cyanogen bromide (CNBr) linkage through a spacer. For non-covalent attachments, addition of an affinity tag sequence to the peptide can be used such as GST (Smith, D. B., and Johnson, K. S., *Gene* 67:31 (1988)), polyhistidines (Hochuli, E., et al., *J. Chromatog.* 411:77 (1987)), or biotin. Alternatively, attachment can be accomplished using a ligand which binds the Fc region of the antibodies of the invention, e.g., protein A or protein G. Such affinity tags may be used for the reversible attachment of the antibodies to the support. Peptides may also be recognized via specific ligand-receptor interactions or using phage display methodologies that will be familiar to the skilled artisan, for their ability to bind polypeptides of the invention or fragments thereof.

Kits

In another aspect, the invention provides kits which may be used in producing the nucleic acid molecules, polypeptides, vectors, host cells, and antibodies, and in the recombinational cloning methods, of the invention. Kits according to this aspect of the invention may comprise one or more containers, which may contain one or more of the nucleic acid molecules, primers, polypeptides, vectors, host cells, or antibodies of the invention. In particular, a kit of the invention may comprise one or more components (or combinations thereof) selected from the group consisting of one or more recombination proteins (e.g., Int) or auxiliary factors (e.g. IHF and/or Xis) or combinations thereof, one or more compositions comprising one or more recombination proteins or auxiliary factors or combinations thereof (for example, GATEWAY™ LR Clonase™ Enzyme Mix or GATEWAY™ BP Clonase™ Enzyme Mix) one or more Destination Vector molecules (including those described herein), one or more Entry Clone or Entry Vector molecules (including those described herein), one or more primer nucleic acid molecules (particularly those described herein), one or more host cells (e.g. competent cells, such as E. coli cells, yeast cells, animal cells (including mammalian cells, insect cells, nematode cells, avian cells, fish cells, etc.), plant cells, and most particularly E. coli DB3, DB3.1 (preferably E. coli LIBRARY EFFICIENCY® DB3.1™ Competent Cells; Life Technologies, Inc., Rockville, Md.), DB4 and DB5; see U.S. Provisional Application No. 60/122,392, filed on Mar. 2, 1999, and the corresponding U.S. Utility Application Ser. No. 09/518,188 of Hartley et al., entitled "Cells Resistant to Toxic Genes and Uses Thereof," filed on even day herewith, the disclosures of which are incorporated by reference herein in its entirety), and the like. In related aspects, the kits of the invention may comprise one or more nucleic acid molecules encoding one or more recombination sites or portions thereof, such as one or more nucleic acid molecules comprising a nucleotide sequence encoding the one or more recombination sites (or portions thereof) of the invention, and particularly one or more of the nucleic acid molecules contained in the deposited clones described herein. Kits according to this aspect of the invention may also comprise one or more isolated nucleic acid molecules of the invention, one or more vectors of the invention, one or more primer nucleic acid molecules of the invention, and/or one or more antibodies of the invention. The kits of the invention may further comprise one or more additional containers containing one or more additional components useful in combination with the nucleic acid molecules, polypeptides, vectors, host cells, or antibodies of the invention, such as one or more buffers, one or more detergents, one or more polypeptides having nucleic acid polymerase activity, one or more polypeptides having reverse transcriptase activity, one or more transfection reagents, one or more nucleotides, and the like. Such kits may be used in any process advantageously using the nucleic acid molecules, primers, vectors, host cells, polypeptides, antibodies and other compositions of the invention, for example in methods of synthesizing nucleic acid molecules (e.g., via amplification such as via PCR), in methods of cloning nucleic acid molecules (preferably via recombinational cloning as described herein), and the like.

Optimization of Recombinational Cloning System

The usefulness of a particular nucleic acid molecule, or vector comprising a nucleic acid molecule, of the invention in methods of recombinational cloning may be determined by any one of a number of assay methods. For example, Entry and Destination vectors of the present invention may be assessed for their ability to function (i.e., to mediate the transfer of a nucleic acid molecule, DNA segment, gene, cDNA molecule or library from a cloning vector to an Expression Vector) by carrying out a recombinational cloning reaction as described in more detail in the Examples below and as described in U.S. application Ser. Nos. 08/663,002, filed Jun. 7, 1996 (now U.S. Pat. No. 5,888,732), 09/005,476, filed Jan. 12, 1998, 09/177,387, filed Oct. 23, 1998, and 60/108,324, filed Nov. 13, 1998, the disclosures of which are incorporated by reference herein in their entireties. Alternatively, the functionality of Entry and Destination Vectors prepared according to the invention may be assessed by examining the ability of these vectors to recombine and create cointegrate molecules, or to transfer a nucleic acid molecule of interest, using an assay such as that described in detail below in Example 19. Analogously, the formulation of compositions comprising one or more recombination proteins or combinations thereof, for example GATEWAY™ LR Clonase™ Enzyme Mix and GATEWAY™ BP Clonase™ Enzyme Mix, may be optimized using assays such as those described below in Example 18.

Uses

There are a number of applications for the compositions, methods and kits of the present invention. These uses include, but are not limited to, changing vectors, targeting gene products to intracellular locations, cleaving fusion tags from desired proteins, operably linking nucleic acid molecules of interest to regulatory genetic sequences (e.g., promoters, enhancers, and the like), constructing genes for fusion proteins, changing copy number, changing replicons, cloning into phages, and cloning, e.g., PCR products, genomic DNAs, and cDNAs. In addition, the nucleic acid molecules, vectors, and host cells of the invention may be used in the production of polypeptides encoded by the nucleic acid molecules, in the production of antibodies directed against such polypeptides, in recombinational cloning of desired nucleic acid sequences, and in other applications that may be enhanced or facilitated by the use of the nucleic acid molecules, vectors, and host cells of the invention.

In particular, the nucleic acid molecules, vectors, host cells, polypeptides, antibodies, and kits of the invention may be used in methods of transferring one or more desired nucleic acid molecules or DNA segments, for example one or more genes, cDNA molecules or cDNA libraries, into a cloning or Expression Vector for use in transforming additional host cells for use in cloning or amplification of, or expression of the polypeptide encoded by, the desired nucleic acid molecule or DNA segment. Such recombinational cloning methods which may advantageously use the nucleic acid molecules, vectors, and host cells of the invention, are described in detail in the Examples below, and in commonly owned U.S. application Ser. Nos. 08/486,139, filed Jun. 7, 1995, 08/663, 002, filed Jun. 7, 1996 (now U.S. Pat. No. 5,888,732), 09/005, 476, filed Jan. 12, 1998, 09/177,387, filed Oct. 23, 1998, and 60/108,324, filed Nov. 13, 1998, the disclosures of all of which are incorporated by reference herein in their entireties.

It will be understood by one of ordinary skill in the relevant arts that other suitable modifications and adaptations to the methods and applications described herein are readily apparent from the description of the invention contained herein in view of information known to the ordinarily skilled artisan, and may be made without departing from the scope of the invention or any embodiment thereof. Having now described the present invention in detail, the same will be more clearly understood by reference to the following examples, which are included herewith for purposes of illustration only and are not intended to be limiting of the invention.

EXAMPLES

Example 1

Recombination Reactions of Bacteriophage λ

Figure 60:
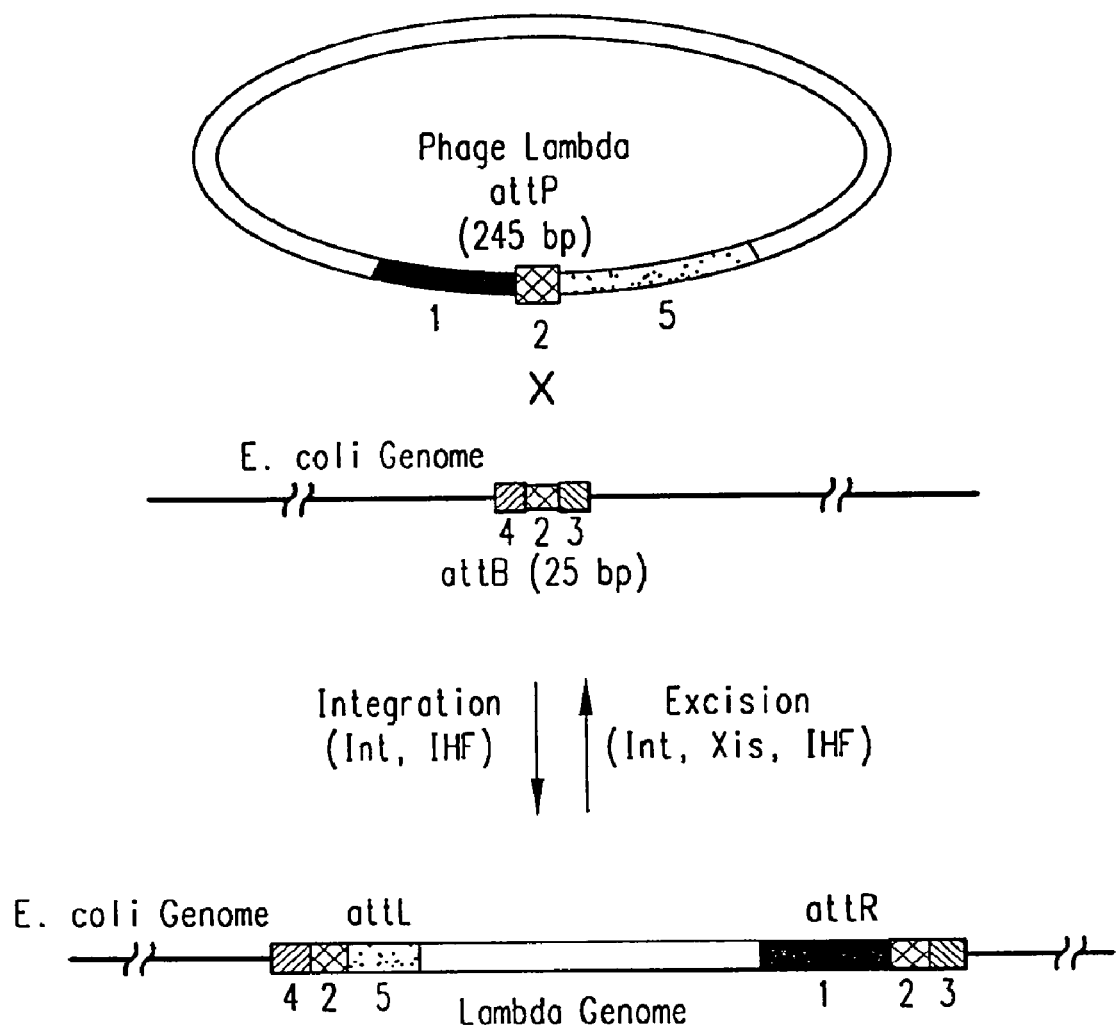
FIG. 60 is a schematic depiction of the bacteriophage lambda recombination pathways in *E. coli*.

The *E. coli* bacteriophage λ can grow as a lytic phage, in which case the host cell is lysed, with the release of progeny virus. Alternatively, lambda can integrate into the genome of its host by a process called lysogenization (see FIG. 60). In this lysogenic state, the phage genome can be transmitted to daughter cells for many generations, until conditions arise that trigger its excision from the genome. At this point, the virus enters the lytic part of its life cycle. The control of the switch between the lytic and lysogenic pathways is one of the best understood processes in molecular biology (M. Ptashne, *A Genetic Switch*, Cell Press, 1992).

The integrative and excisive recombination reactions of λ, performed in vitro, are the basis of Recombinational Cloning System of the present invention. They can be represented schematically as follows:

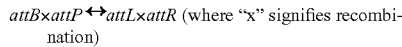
(where "x" signifies recombination)

The four att sites contain binding sites for the proteins that mediate the reactions. The wild type attP, attB, attL, and attR sites contain about 243, 25, 100, and 168 base pairs, respectively. The attB×attP reaction (hereinafter referred to as a "BP Reaction," or alternatively and equivalently as an "Entry Reaction" or a "Gateward Reaction") is mediated by the proteins Int and IHF. The attL×attR reaction (hereinafter referred to as an "LR Reaction," or alternatively and equivalently as a "Destination Reaction") is mediated by the proteins Int, IHF, and Xis. Int (integrase) and Xis (excisionase) are encoded by the λ genome, while IHF (integration host factor) is an *E. coli* protein. For a general review of lambda recombination, see: A. Landy, *Ann. Rev. Biochem.* 58: 913-949 (1989).

Example 2

Recombination Reactions of the Recombinational Cloning System

The LR Reaction—the exchange of a DNA segment from an Entry Clone to a Destination Vector—is the in vitro version of the λ excision reaction:

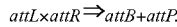

There is a practical imperative for this configuration: after an LR Reaction in one configuration of the present method, an att site usually separates a functional motif (such as a promoter or a fusion tag) from a nucleic acid molecule of interest in an Expression Clone, and the 25 bp attB site is much smaller than the attP, attL, and attR sites.

Note that the recombination reaction is conservative, i.e., there is no net synthesis or loss of base pairs. The DNA segments that flank the recombination sites are merely switched. The wild type λ recombination sites are modified for purposes of the GATEWAY™ Cloning System, as follows:

To create certain preferred Destination Vectors, a part (43 bp) of attR was removed, to make the excisive reaction irreversible and more efficient (W. Bushman et al., *Science* 230: 906, 1985). The attR sites in preferred Destination Vectors of the invention are 125 bp in length. Mutations were made to the core regions of the att sites, for two reasons: (1) to eliminate stop codons, and (2) to ensure specificity of the recombination reactions (i.e., attR1 reacts only with attL1, attR2 reacts only with attL2, etc.).

Other mutations were introduced into the short (5 bp) regions flanking the 15 bp core regions of the attB sites to minimize secondary structure formation in single-stranded forms of attB plasmids, e.g., in phagemid ssDNA or in mRNA. Sequences of attB1 and attB2 to the left and right of a nucleic acid molecule of interest after it has been cloned into a Destination Vector are given in FIG. 6.

Figure 61:
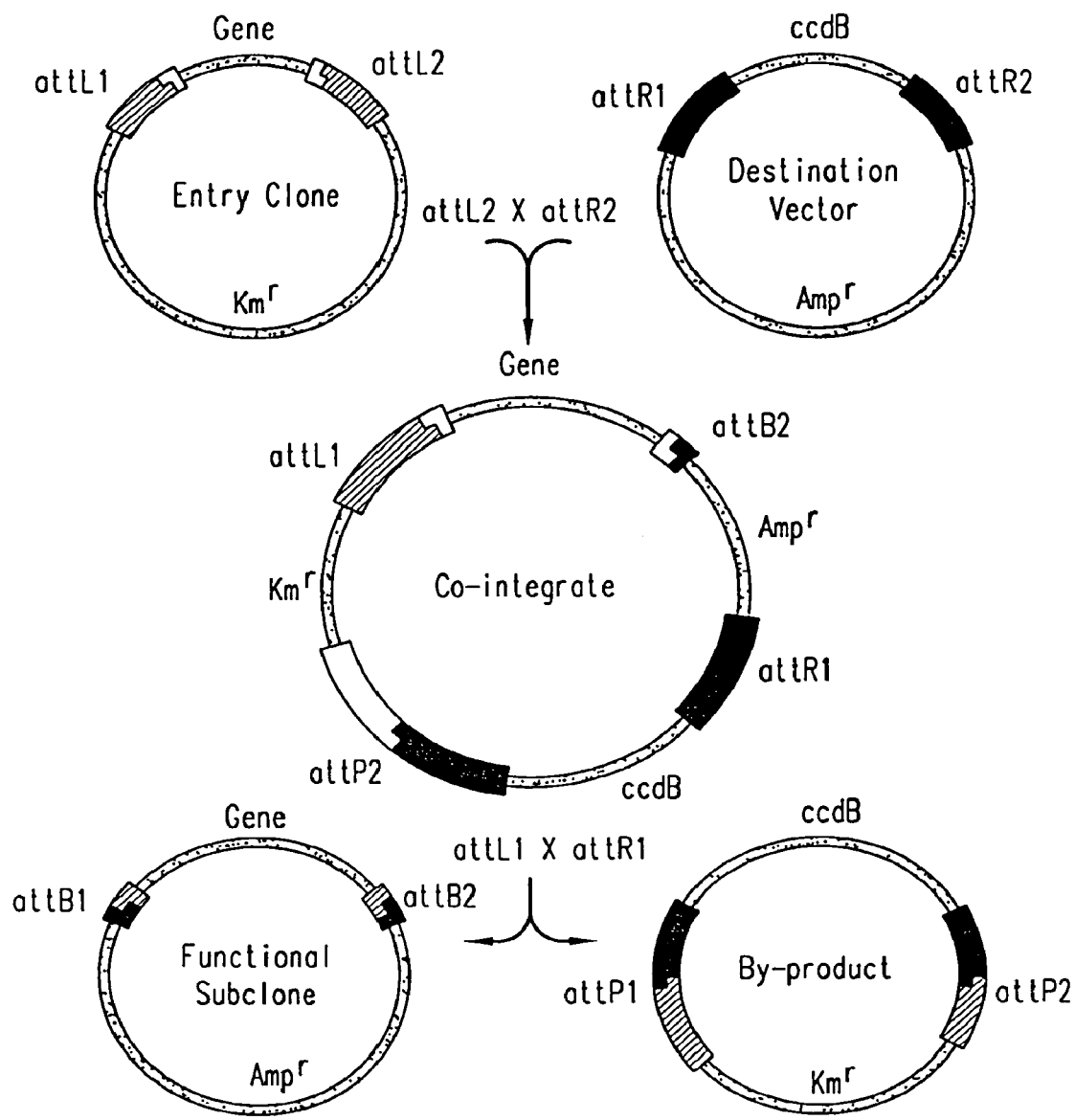
FIG. 61 is a schematic depiction of the DNA molecules participating in the LR Reaction. Two different co-integrates form during the LR Reaction (only one of which is shown here), depending on whether attL1 and attR1 or attL2 and attR2 are first to recombine. In one aspect, the invention provides directional cloning of a nucleic acid molecule of interest, since the recombination sites react with specificity (attL1 reacts with attR1; attL2 with attR2; attB1 with attP1; and attB2 with attP2). Thus, positioning of the sites allows construction of desired vectors having recombined fragments in the desired orientation.

FIG. 61 illustrates how an Entry Clone and a Destination Vector recombine in the LR Reaction to form a co-integrate, which resolves through a second reaction into two daughter molecules. The two daughter molecules have the same general structure regardless of which pair of sites, attL1 and attR1 or attL2 and attR2, react first to form the co-integrate. The segments change partners by these reactions, regardless of whether the parental molecules are both circular, one is circular and one is linear, or both are linear. In this example, selection for ampicillin resistance carried on the Destination Vector, which also carries the death gene ccdB, provides the means for selecting only for the desired attB product plasmid.

Example 3

Protein Expression in the Recombinational Cloning System

Proteins are expressed in vivo as a result of two processes, transcription (DNA into RNA), and translation (RNA into protein). For a review of protein expression in prokaryotes and eukaryotes, see Example 13 below. Many vectors (pUC, BlueScript, pGem) use interruption of a transcribed lacZ gene for blue-white screening. These plasmids, and many Expression Vectors, use the lac promoter to control expression of cloned genes. Transcription from the lac promoter is turned on by adding the inducer IPTG. However, a low level of RNA is made in the absence of inducer, i.e., the lac promoter is never completely off. The result of this "leakiness" is that genes whose expression is harmful to *E. coli* may prove difficult or impossible to clone in vectors that contain the lac promoter, or they may be cloned only as inactive mutants.

In contrast to other gene expression systems, nucleic acid molecules cloned into an Entry Vector may be designed not to be expressed. The presence of the strong transcriptional terminator rrnB (Orosz, et al., *Eur. J. Biochem.* 201: 653, 1991) just upstream of the attL1 site keeps transcription from the vector promoters (drug resistance and replication origin) from reaching the cloned gene. However, if a toxic gene is cloned into a Destination Vector, the host may be sick, just as in other expression systems. But the reliability of subcloning by in vitro recombination makes it easier to recognize that this has happened—and easier to try another expression option in accordance with the methods of the invention, if necessary.

Example 4

Choosing the Right Entry Vector

There are two kinds of choices that must be made in choosing the best Entry Vector, dictated by (1) the particular DNA segment that is to be cloned, and (2) what is to be accomplished with the cloned DNA segment. These factors are critical in the choice of Entry Vector used, because when the desired nucleic acid molecule of interest is moved from the Entry Vector to a Destination Vector, all the base pairs between the nucleic acid molecule of interest and the Int cutting sites in attL1 and attL2 (such as in FIG. 6) move into the Destination Vector as well. For genomic DNAs that are not expressed as a result of moving into a Destination Vector, these decisions are not as critical.

For example, if an Entry Vector with certain translation start signals is used, those sequences will be translated into amino acids if an amino-terminal fusion to the desired nucleic acid molecule of interest is made. Whether the desired nucleic acid molecule of interest is to be expressed as fusion protein, native protein, or both, dictates whether translational start sequences must be included between the attB sites of the clone (native protein) or, alternatively, supplied by the Destination Vector (fusion protein). In particular, Entry Clones that include translational start sequences may prove less suitable for making fusion proteins, as internal initiation of translation at these sites can decrease the yield of N-terminal fusion protein. These two types of expression afforded by the compositions and methods of the invention are illustrated in FIG. 62.

No Entry Vector is likely to be optimal for all applications. The nucleic acid molecule of interest may be cloned into any of several optimal Entry Vectors.

As an example, consider pENTR7 (FIG. 16) and pENTR11 (FIG. 20), which are useful in a variety of applications, including (but not limited to):

Cloning cDNAs from most of the commercially available libraries. The sites to the left and right of the ccdB death gene have been chosen so that directional cloning is possible if the DNA to be cloned does not have two or more of these restriction sites.

Cloning of genes directionally: SalI, BamHI, XmnI (blunt), or KpnI on the left of ccdB; NotI, XhoI, XbaI, or EcoRV (blunt), on the right.

Cloning of genes or gene fragments with a blunt amino end at the XmnI site. The XmnI site has four of the six most favored bases for eukaryotic expression (see Example 13, below), so that if the first three bases of the DNA to be cloned are ATG, the open reading frame (ORF) will be expressed in eukaryotic cells (e.g., mammalian cells, insect cells, yeast cells) when it is transcribed in the appropriate Destination Vector. In addition, in pENTR11, a Shine-Dalgarno sequence is situated 8 bp upstream, for initiating protein synthesis in a prokaryotic host cell (particularly a bacterial cell, such as $E.\ coli$) at an ATG.

Cleaving off amino terminal fusions (e.g., $His_6$, GST, or thioredoxin) using the highly specific TEV (Tobacco Etch Virus) protease (available from Life Technologies, Inc.). If the nucleic acid molecule of interest is cloned at the blunt XmnI site, TEV cleavage will leave two amino acids on the amino end of the expressed protein.

Selecting against uncut or singly cut Entry Vector molecules during cloning with restriction enzymes and ligase. If the ccdB gene is not removed with a double digest, it will kill any recipient $E.\ coli$ cell that does not contain a mutation that makes the cell resistant to ccdB (see U.S. Provisional Application No. 60/122,392, filed on Mar. 2, 1999, the disclosure of which is incorporated by reference herein in its entirety).

Allowing production of amino fusions with ORFs in all cloning sites. There are no stop codons (in the attL1 reading frame) upstream of the ccdB gene.

In addition, pENTR11 is also useful in the following applications:

Cloning cDNAs that have an NcoI site at the initiating ATG into the NcoI site. Similar to the XmnI site, this site has four of the six most favored bases for eukaryotic expression. Also, a Shine-Dalgarno sequence is situated 8 bp upstream, for initiating protein synthesis in a prokaryotic host cell (particularly a bacterial cell, such as $E.\ coli$) at an ATG.

Producing carboxy fusion proteins with ORFs positioned in phase with the reading frame convention for carboxy-terminal fusions (see FIG. 20A).

Table 1 lists some non-limiting examples of Entry Vectors and their characteristics, and FIGS. 10-20 show their cloning sites. All of the Entry Vectors listed in Table 1 are available commercially from Life Technologies, Inc., Rockville, Md. Other Entry Vectors not specifically listed here, which comprise alternative or additional features may be made by one of ordinary skill using routine methods of molecular and cellular biology, in view of the disclosure contained herein.

TABLE 1

Examples of Entry Vectors

| Designation | Mnemonic Name | Class of Entry Vector | Distinctive Cloning Sites | Amino Fusions | Native Protein in E. coli | Native Protein in Eukaryotic Cells | Protein Synthesis Features |
|---|---|---|---|---|---|---|---|
| pENTR-1A, 2B, 3C | Minimal blunt RF A, B ,C | Alternative Reading Frame Vectors | Reading frame A, B, or C; blunt cut closest to attL1 | Good | Poor | Good | Minimal amino acids between tag and protein; no SD |
| pENTR4 | Minimal Nco | Restr. Enz. Cleavage Vectors | Nco I site (common in euk. cDNAs) closest to attL1 | Good | Poor | Good | Good Kozac; no SD |
| pENTR5 | Minimal Nde | Restr. Enz. Cleavage Vectors | NdeI site closest to attL1 | Good | Poor | Poor at Nde I, Good at Xmn I | No SD; poor Kozac at Nde, good at Xmn |
| pENTR6 | Minimal Sph | Restr. Enz. Cleavage Vectors | Sph I site closest to attL1 | Good | Poor | Poor at Sph I, Good at Xmn I | No SD; poor Kozac at Sph, good at Xmn |

TABLE 1-continued

Examples of Entry Vectors

| Designation | Mnemonic Name | Class of Entry Vector | Distinctive Cloning Sites | Amino Fusions | Native Protein in E. coli | Native Protein in Eukaryotic Cells | Protein Synthesis Features |
|---|---|---|---|---|---|---|---|
| pENTR7 | TEV Blunt | TEV Cleavage Site Present | Xmn I (blunt) is first cloning site after TEV site | Good | Poor | Good at Xmn I site | TEV protease leaves Gly-Thr on amino end of protein; no SD |
| pENTR8 | TEV Nco | TEV Cleavage Site Present | Nco I is first cloning site after TEV site | Good | Poor | Good | TEV protease leaves Gly-Thr on amino end of protein; no SD |
| pENTR9 | TEV Nde | TEV Cleavage Site Present | Nde I is first cloning site after TEV site | Good | Poor | Poor | TEV protease leaves Gly-Thr on amino end of protein; no SD, poor Kozac |
| pENTR10 | Nde with SD | Good SD for E. coli Expression | Strong SD; Nde I site, no TEV | Poor | Good | Poor | Strong SD, internal starts in amino fusions. Poor Kz. No TEV |
| pENTR11 | 2 X SD + Kozac | Good SD for E. coli Expression | Xmn I (blunt) and Nco I sites each preceded by SD and Kozac | Good | Good | Good | Strong SD/Koz Internal starts in amino fusions. No TEV |

Entry vectors pENTR1A (FIGS. 10A and 10B), pENTR2B (FIGS. 11A and 11B), and pENTR3C (FIGS. 12A and 12B) are almost identical, except that the restriction sites are in different reading frames. Entry vectors pENTR4 (FIGS. 13A and 13B), pENTR5 (FIGS. 14A and 14B), and pENTR6 (FIGS. 15A and 15B) are essentially identical to pENTR1A, except that the blunt DraI site has been replaced with sites containing the ATG methionine codon: NcoI in pENTR4, NdeI in pENTR5, and SphI in pENTR6. Nucleic acid molecules that contain one of these sites at the initiating ATG can be conveniently cloned in these Entry vectors. The NcoI site in pENTR4 is especially useful for expression of nucleic acid molecules in eukaryotic cells, since it contains many of the bases that give efficient translation (see Example 13, below). (Nucleic acid molecules of interest cloned into the NdeI site of pENTR5 are not expected to be highly expressed in eukaryotic cells, because the cytosine at position-3 from the initiating ATG is rare in eukaryotic genes.)

Entry vectors pENTR7 (FIGS. 16A and 16B), pENTR8 (FIGS. 17A and 17B), and pENTR9 (FIGS. 18A and 18B) contain the recognition site for the TEV protease between the attL1 site and the cloning sites. Cleavage sites for XmnI (blunt), NcoI, and NdeI, respectively, are the most 5' sites in these Entry vectors. Amino fusions can be removed efficiently if nucleic acid molecules are cloned into these Entry vectors. TEV protease is highly active and highly specific.

Example 5

Controlling Reading Frame

One of the trickiest tasks in expression of cloned nucleic acid molecules is making sure the reading frame is correct. (Reading frame is important if fusions are being made between two ORFs, for example between a nucleic acid molecule of interest and a His6 or GST domain.) For purposes of the present invention, the following convention has been adopted: The reading frame of the DNA cloned into any Entry Vector must be in phase with that of the attB1 site shown in FIG. 16A, pENTR7. Notice that the six As of the attL1 site are split into two lysine codons (aaa aaa). The Destination Vectors that make amino fusions were constructed such that they enter the attR1 site in this reading frame. Destination Vectors for carboxy terminal fusions were also constructed, including those containing $His_6$ (pDEST23; FIG. 43), GST (pDEST24; FIG. 44), or thioredoxin (pDEST25; FIG. 45) C-terminal fusion sequences.

Therefore, if a nucleic acid molecule of interest is cloned into an Entry Vector so that the aaa aaa reading frame within the attL1 site is in phase with the nucleic acid molecule's ORF, amino terminal fusions will automatically be correctly phased, for all the fusion tags. This is a significant improvement over the usual case, where each different vector can have different restriction sites and different reading frames.

See Example 15 for a practical example of how to choose the most appropriate combinations of Entry Vector and Destination Vector.

Materials

Unless otherwise indicated, the following materials were used in the remaining Examples included herein:

5×LR Reaction Buffer:
    200-250 mM (preferably 250 mM) Tris-HCl, pH 7.5
    250-350 mM (preferably 320 mM) NaCl
    1.25-5 mM (preferably 4.75 mM) EDTA
    12.5-35 mM (preferably 22-35 mM, and most preferably 35 mM)
    Spermidine-HCl
    1 mg/ml bovine serum albumin GATEWAY™ LR Clonase™ Enzyme Mix:
    Per 4 µl of 1×LR Reaction Buffer:
    150 ng carboxy-His6-tagged Int (see U.S. Appl. Nos. 60/108,324, filed Nov. 13, 1998, and 09/438,358, filed Nov. 12, 1999, both entirely incorporated by reference herein)
    25 ng carboxy-His6-tagged Xis (see U.S. Appl. Nos. 60/108,324, filed Nov. 13, 1998, and 09/438,358, filed Nov. 12, 1999, both entirely incorporated by reference herein)
    30 ng IHF
    50% glycerol 5×BP Reaction Buffer:
  125 mM Tris-HCl, pH 7.5
  110 mM NaCl
  25 mM EDTA
  25 mM Spermidine-HCl
  5 mg/ml bovine serum albumin
GATEWAY™ BP Clonase™ Enzyme Mix:
  Per 4 µl of 1×BP Reaction Buffer:
    200 ng carboxy-His6-tagged Int (see U.S. Appl. Nos. 60/108,324, filed Nov. 13, 1998, and 09/438,358, filed Nov. 12, 1999, both entirely incorporated by reference herein)
    80 ng IHF
    50% glycerol
10× Clonase Stop Solution:
  50 mM Tris-HCl, pH 8.0
  1 mM EDTA
  2 mg/ml Proteinase K Example 6

LR ("Destination") Reaction

To create a new Expression Clone containing the nucleic acid molecule of interest (and which may be introduced into a host cell, ultimately for production of the polypeptide encoded by the nucleic acid molecule), an Entry Clone or Vector containing the nucleic acid molecule of interest, prepared as described herein, is reacted with a Destination Vector. In the present example, a β-Gal gene flanked by attL sites is transferred from an Entry Clone to a Destination Vector.

Materials Needed:
  5×LR Reaction buffer
  Destination Vector (preferably linearized), 75-150 ng/µl
  Entry Clone containing nucleic acid molecule of interest, 100-300 ng in ≦8 µl TE buffer
  Positive control Entry Clone (pENTR-β-Gal) DNA (See note, below)
  Positive control Destination Vector, pDEST1(pTrc), 75 ng/µl
  GATEWAY™ LR Clonase™ Enzyme Mix (stored at −80° C.)
  10× Clonase Stop solution
  pUC19 DNA, 10 pg/µl
  Chemically competent *E. coli* cells (competence: ≧1×10$^7$ CFU/µg), 400 µl.
  LB Plates containing ampicillin (100 µg/ml) and methicillin (200 µg/ml)±X-gal and IPTG (See below)

Notes:
Preparation of the Entry Clone DNA: Miniprep DNA that has been Treated with RNase works well. A reasonably accurate quantitation (±50%) of the DNA to be cloned is advised, as the GATEWAY™ reaction appears to have an optimum of about 100-300 ng of Entry Clone per 20 µl of reaction nix.

The positive control Entry Clone, pENTR-β-Gal, permits functional analysis of clones based on the numbers of expected blue vs. white colonies on LB plates containing IPTG+Bluo-gal (or X-gal), in addition to ampicillin (100 µg/ml) and methicillin (200 µg/ml). Because β-Galactosidase is a large protein, it often yields a less prominent band than many smaller proteins do on SDS protein gels.

In the Positive Control Entry Vector pENTR-β-Gal, the coding sequence of β-Gal has been cloned into pENTR11 (FIGS. 20A and 20B), with translational start signals permitting expression in *E. coli*, as well as in eukaryotic cells. The positive control Destination Vector, for example pDEST1 (FIG. 21), is preferably linearized.

To prepare X-gal+IPTG plates, either of the following protocols may be used:

A. With a glass rod, spread over the surface of an LB agar plate: 40 µl of 20 mg/ml X-gal (or Bluo-gal) in DMF plus 4 µl 200 mg/ml IPTG. Allow liquid to adsorb into agar for 3-4 hours at 37° C. before plating cells.

B. To liquid LB agar at ~45° C., add: X-gal (or Bluo-Gal) (20 mg/ml in DMF) to make 50 µg/ml and IPTG (200 mM in water) to make 0.5-1 mM, just prior to pouring plates. Store X-gal and Bluo-Gal in a light-shielded container.

Colony color may be enhanced by placing the plates at 5° C. for a few hours after the overnight incubation at 37° C. Protocol B can give more consistent colony color than A, but A is more convenient when selection plates are needed on short notice.

Recombination in Clonase reactions continues for many hours. While incubations of 45-60 minutes are usually sufficient, reactions with large DNAs, or in which both parental DNAs are supercoiled, or which will be transformed into cells of low competence, can be improved with longer incubation times, such as 2-24 hours at 25° C.

Procedure:
1. Assemble reactions as follows (combine all components at room temperature, except GATEWAY™ LR Clonase™ Enzyme Mix ("Clonase LR"), before removing Clonase LR from frozen storage):

| Component | Tube 1 Neg. | Tube 2 Pos. | Tube 3 Neg. | Tube 4 Test |
|---|---|---|---|---|
| p-Gate-βGal, (Positive control Entry Clone) 75 ng/µl | 4 µl | 4 µl | | |
| pDEST1 (Positive control Destination Vector), 75 ng/µl | 4 µl | 4 µl | | |
| Your Entry Clone (100-300 ng) | | | 1-8 µl | 1-8 µl |
| Destination Vector for your nucleic acid molecule, 75 ng/µl | | | 4 µl | 4 µl |
| 5× LR Reaction Buffer | 4 µl | 4 µl | 4 µl | 4 µl |
| TE | 8 µl | 4 µl | To 20 µl | To 16 µl |
| GATEWAY ™ LR Clonase ™ Enzyme Mix (store at −80° C., add last) | — | 4 µl | — | 4 µl |
| Total Volume | 20 µl | 20 µl | 20 µl | 20 µl |

2. Remove the GATEWAY™ LR Clonase™ Enzyme Mix from the −80° C. freezer, place immediately on ice. The Clonase takes only a few minutes to thaw.
3. Add 4 µl of GATEWAY™ LR Clonase™ Enzyme Mix to reactions #2 and #4; 4. Return GATEWAY™ LR Clonase™ Enzyme Mix to −80° C. freezer.
5. Incubate tubes at 25° for at least 60 minutes.
6. Add 2 µl Clonase Stop solution to all reactions. Incubate for 20 min at 37° C. (This step usually increases the total number of colonies obtained by 10-20 fold.)
7. Transform 2 µl into 100 µl competent *E. coli*. Select on plates containing ampicillin at 100 µg/ml.

Example 7

Transformation of *E. coli*

To introduce cloning or Expression Vectors prepared using the recombinational cloning system of the invention, any standard *E. coli* transformation protocol should be satisfactory. The following steps are recommended for best results:

1. Let the mixture of competent cells and Recombinational Cloning System reaction product stand on ice at least 15 minutes prior to the heat-shock step. This gives time for the recombination proteins to dissociate from the DNA, and improves the transformation efficiency.
2. Expect the reaction to be about 1%-5% efficient, i.e., 2 µl of the reaction should contain at least 100 pg of the Expression Clone plasmid (taking into account the amounts of each parental plasmid in the reaction, and the subsequent dilution). If the *E. coli* cells have a competence of $10^7$ CFU/µg, 100 pg of the desired clone plasmid will give about 1000 colonies, or more, if the entire transformation is spread on one ampicillin plate.
3. Always do a control pUC DNA transformation. If the number of colonies is not what you expect, the pUC DNA transformation gives you an indication of where the problem was.

Example 8

Preparation of attB-PCR Product

For preparation of attB-PCR products in the PCR cloning methods described in Example 9 below, PCR primers containing attB1 and attB2 sequences are used. The attB1 and attB2 primer sequences are as follows:

attB1:
(SEQ ID NO: 31)
5'-GGGGACAAGTTTGTACAAAAAAGCAGGCT-(template-specific sequence)-3' attB2:
(SEQ ID NO: 32)
5'-GGGGACCACTTTGTACAAGAAAGCTGGGT-(template-specific sequence)-3'

The attB1 sequence should be added to the amino primer, and the attB2 sequence to the carboxy primer. The 4 guanines at the 5' ends of each of these primers enhance the efficiency of the minimal 25 bp attB sequences as substrates for use in the cloning methods of the invention.

Standard PCR conditions may be used to prepare the PCR product. The following suggested protocol employs PLATINUM Taq DNA Polymerase High Fidelity®, available commercially from Life Technologies, Inc. (Rockville, Md.). This enzyme mix eliminates the need for hot starts, has improved fidelity over Taq, and permits synthesis of a wide range of amplicon sizes, from 200 bp to 10 kb, or more, even on genomic templates.

Materials Needed:
PLATINUM Taq DNA Polymerase High Fidelity® (Life Technologies, Inc.)
attB1- and attB2-containing primer pair (see above) specific for your template
DNA template (linearized plasmid or genomic DNA)
10× High Fidelity PCR Buffer
10 mM dNTP mix
PEG/MgCl$_2$ Mix (30% PEG 8000, 30 mM MgCl$_2$)

Procedure:
1.) Assemble the reaction as follows:

| Component | Reaction with Plasmid Target | Reaction with Genomic Target |
|---|---|---|
| 10× High Fidelity PCR Buffer | 5 µl | 5 µl |
| dNTP Mix 10 mM | 1 µl | 1 µl |
| MgSO$_4$, 50 mM | 2 µl | 2 µl |
| attB1 Primer, 10 µM | 2 µl | 1 µl |
| attB2 Primer, 10 µM | 2 µl | 1 µl |
| Template DNA | 1-5 ng* | ≧100 ng |
| PLATINUM Taq High Fidelity | 2 µl | 1 µl |
| Water | to 50 µl | to 50 µl |

*Use of higher amounts of plasmid template may permit fewer cycles (10-15) of PCR 2.) Add 2 drops mineral oil, as appropriate.
3.) Denature for 30 sec. at 94° C.
4.) Perform 25 cycles:
   94° C. for 15 sec-30 sec
   55° C. for 15 sec-30 sec
   68° C. for 1 nm per kb of template.
5.) Following the PCR reaction, apply 1-2 µl of the reaction mixture to an agarose gel, together with size standards (e.g., 1 Kb Plus Ladder, Life Technologies, Inc.) and quantitation standards (e.g., Low Mass Ladder, Life Technologies, Inc.), to assess the yield and uniformity of the product.

Purification of the PCR product is recommended, to remove attB primer dimers which can clone efficiently into the Entry Vector. The following protocol is fast and will remove DNA <300 bp in size:
6.) Dilute the 50 µl PCR reaction to 200 µl with TE.
7.) Add 100 µl PEG/MgCl$_2$ Solution. Mix and centrifuge immediately at 13,000 RPM for 10 min at room temperature. Remove the supernatant (pellet is clear and hard to see).
8.) Dissolve the pellet in 50 µl TE and check recovery on a gel.

If the starting PCR template is a plasmid that contains the gene for Kan$^r$, it is advisable to treat the completed PCR reaction with the restriction enzyme DpnI, to degrade the plasmid since unreacted residual starting plasmid is a potential source of false-positive colonies from the transformation of the GATEWAY™ Cloning System reaction. Adding ~5 units of DpnI to the completed PCR reaction and incubating for 15 min at 37° C. will eliminate this potential problem. Heat inactivate the DpnI at 65° C. for 15 min, prior to using the PCR product in the GATEWAY™ Cloning System reaction.

Example 9

Cloning attB-PCR Products into Entry Vectors via the BP ("Gateward") Reaction

The addition of 5'-terminal attB sequences to PCR primers allows synthesis of a PCR product that is an efficient substrate for recombination with a Donor (attP) Plasmid in the presence of GATEWAY™ BP Clonase™ Enzyme Mix. This reaction produces an Entry Clone of the PCR product (See FIG. 8).

The conditions of the Gateward Cloning reaction with an attB PCR substrate are similar to those of the BP Reaction (see Example 10 below), except that the attB-PCR product (see Example 8) substitutes for the Expression Clone, and the attB-PCR positive control (attB-tet$^r$) substitutes for the Expression Clone Positive Control (GFP).

Materials Needed:
- 5×BP Reaction Buffer
- Desired attB-PCR product DNA, 50-100 ng in ≦8 µl TE.
- Donor (attP) Plasmid (FIGS. 49-54), 75 ng/µl, supercoiled DNA
- attB-tet$^r$ PCR product positive control, 25 ng/µl
- GATEWAY™ BP Clonase™ Enzyme Mix (stored at −80° C.)
- 10× Clonase Stop Solution
- pUC19 DNA, 10 pg/µl.
- Chemically competent *E. coli* cells (competence: ≧1×10$^7$ CFU/µg), 400 µl Notes:
Preparation of attB-PCR DNA: see Example 8.

The Positive Control attB-tet$^r$ PCR product contains a functional copy of the tet$^r$ gene of pBR322, with its own promoter. By plating the transformation of the control BP Reaction on kanamycin (50 µg/ml) plates (if kan$^r$ Donor Plasmids are used; see FIGS. 49-52) or an alternative selection agent (e.g., gentamycin, if gen$^r$ Donor Plasmids are used; see FIG. 54), and then picking about 50 of these colonies onto plates with tetracycline (20 µg/ml), the percentage of Entry Clones containing functional tet$^r$ among the colonies from the positive control reaction can be determined (% Expression Clones= (number of tet$^r$+kan$^r$ (or gen$^r$) colonies/kan$^r$ (or gen$^r$) colonies).

Procedure:

1. Assemble reactions as follows. Combine all components except GATEWAY™ BP Clonase™ Enzyme Mix, before removing GATEWAY™ BP Clonase™ Enzyme Mix from frozen storage.

| Component | Neg. Tube 1 | Pos. Tube 2 | Test Tube 3 |
|---|---|---|---|
| attB-PCR product, 50-100 ng | | | 1-8 µl |
| Donor (attP) Plasmid 75 ng/µl | 2 µl | 2 µl | 2 µl |
| attB-PCR tet$^r$ control DNA (75 ng/µl) | | 4 µl | |
| 5× BP Reaction Buffer | 4 µl | 4 µl | 4 µl |
| TE | 10 µl | 6 µl | To 16 µl |
| GATEWAY ™ BP Clonase ™ Enzyme Mix (store at −80° C., add last) | 4 µl | 4 µl | 4 µl |
| Total Volume | 20 µl | 20 µl | 20 µl |

2. Remove the GATEWAY™ BP Clonase™ Enzyme Mix from the −80° C. freezer, place immediately on ice. The Clonase takes only a few minutes to thaw.
3. Add 4 µl of GATEWAY™ BP Clonase™ Enzyme Mix to the subcloning reaction, mix.
4. Return GATEWAY™ BP Clonase™ Enzyme Mix to −80° C. freezer.
5. Incubate tubes at 25° for at least 60 minutes.
6. Add 2 µl Proteinase K (2 µg/µl) to all reactions. Incubate for 20 min at 37° C.
7. Transform 2 µl into 100 µl competent *E. coli*, as per 3.2, above. Select on LB plates containing kanamycin, 50 µg/ml.

Figure 65:
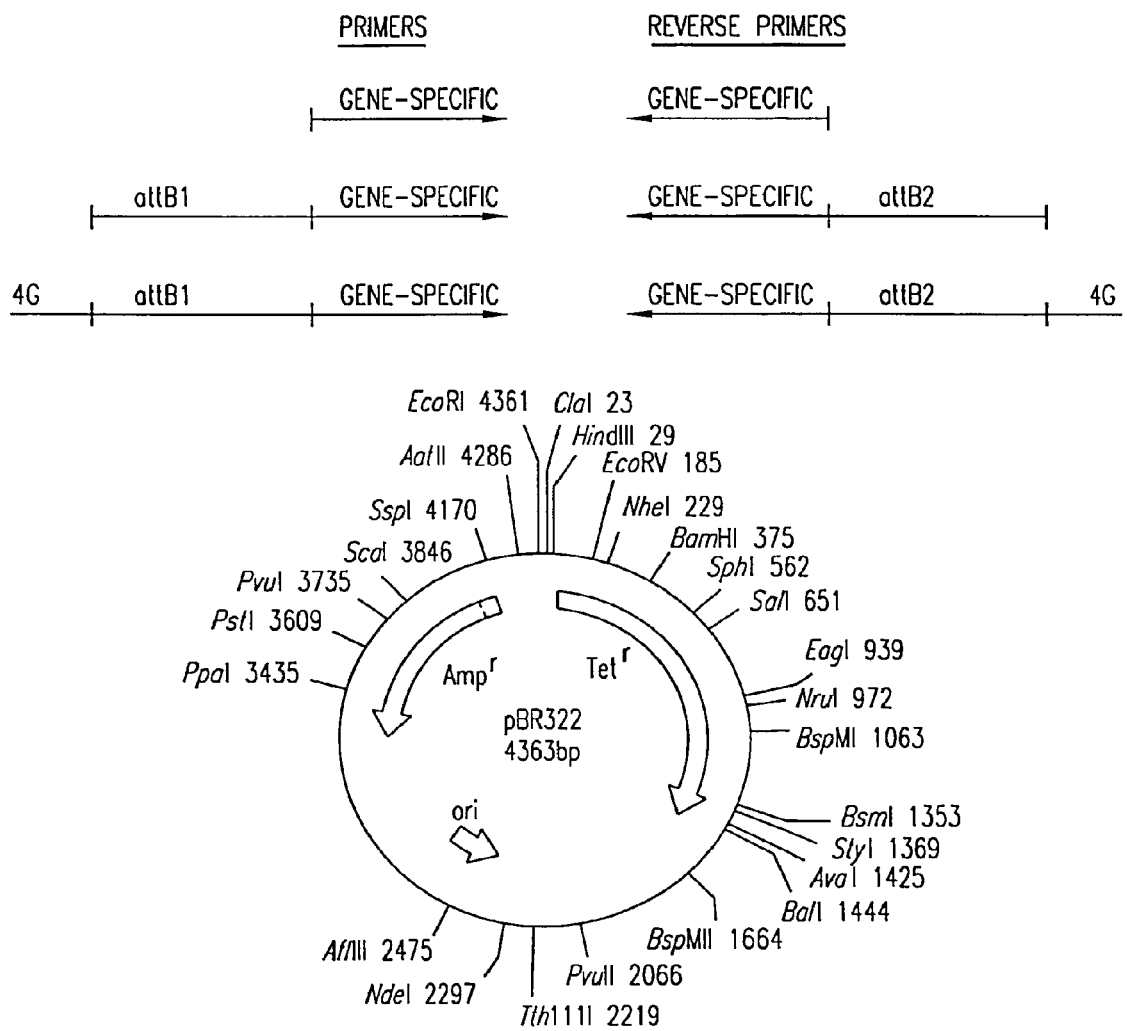
FIG. 65 depicts the attB primers used for amplifying the tet$^r$ and amp$^r$ genes from pBR322 by the cloning methods of the invention.
Figure 67:
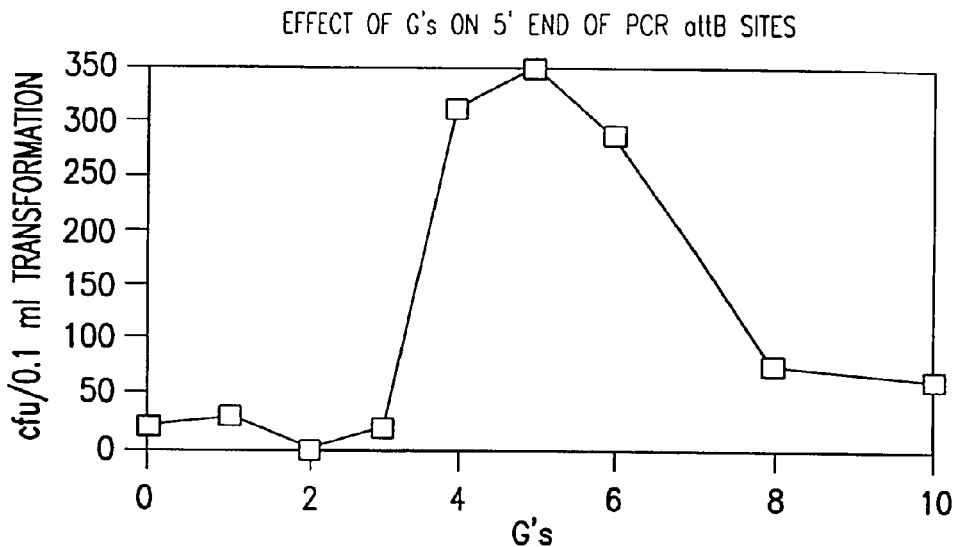
FIG. 67 is a graph showing the effect of the number of guanines (G's) contained on the 5' end of the PCR primers on the cloning efficiency of PCR products. It is noted, however, that other nucleotides besides guanine (including A, T, C, U or combinations thereof) may be used as 5' extensions on the PCR primers to enhance cloning efficiency of PCR products.

Results:

In initial experiments, primers for amplifying tetR and ampR from pBR322 were constructed containing only the tetR- or ampR-specific targeting sequences, the targeting sequences plus attB1 (for forward primers) or attB2 (for reverse primers) sequences shown in FIG. 9, or the attB1 or attB2 sequences with a 5' tail of four guanines. The construction of these primers is depicted in FIG. 65. After PCR amplification of tetR and ampR from pBR322 using these primers and cloning the PCR products into host cells using the recombinational cloning system of the invention, the results shown in FIG. 66 were obtained. These results demonstrated that primers containing attB sequences provided for a somewhat higher number of colonies on the tetracycline and ampicillin plates. However, inclusion of the 5' extensions of four or five guanines on the primers in addition to the attB sequences provided significantly better cloning results, as shown in FIGS. 66 and 67. These results indicate that the optimal primers for cloning of PCR products using recombinational cloning will contain the recombination site sequences with a 5' extension of four or five guanine bases.

Figure 68:
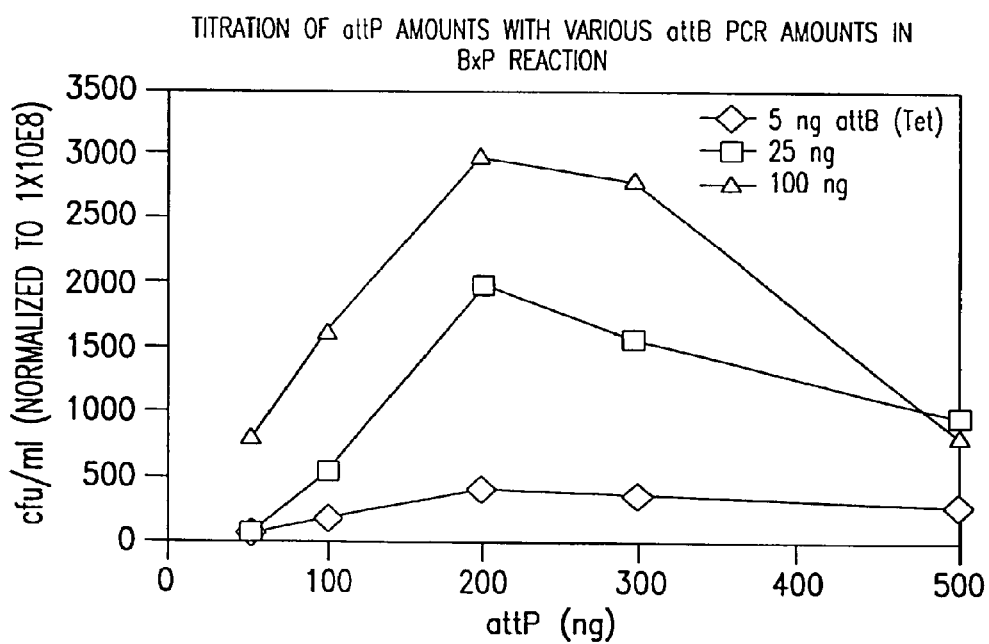
FIG. 68 is a graph showing a titration of various amounts of attP and attB reactants in the B×P reaction, and the effects on cloning efficiency of PCR products.

To determine the optimal stoichiometry between attB-containing PCR products and attP-containing Donor plasmid, experiments were conducted where the amount of PCR product and Donor plasmid were varied during the BP Reaction. Reaction mixtures were then transformed into host cells and plated on tetracycline plates as above. Results are shown in FIG. 68. These results indicate that, for optimal recombinational cloning results with a PCR product in the size range of the tet gene, the amounts of attP-containing Donor plasmids are between about 100-500 ng (most preferably about 200-300 ng), while the optimal concentrations of attB-containing PCR products is about 25-100 ng (most preferably about 100 ng), per 20 µl reaction.

Experiments were then conducted to examine the effect of PCR product size on efficiency of cloning via the recombinational cloning approach of the invention. PCR products containing attB1 and attB2 sites, at sizes 256 bp, 1 kb, 1.4 kb, 3.4 kb, 4.6 kb, 6.9 kb and 10.1 kb were prepared and cloned into Entry vectors as described above, and host cells were transformed with the Entry vectors containing the cloned PCR products. For each PCR product, cloning efficiency was calculated relative to cloning of pUC19 positive control plasmids as follows:

$$\text{Cloning Efficiency} = \frac{CFU/\text{ng } attB \text{ } PCR \text{ product}}{CFU/\text{ng } pUC19 \text{ control}} \times \frac{\text{Size (kb) } PCR \text{ product}}{\text{Size (kb)} pUC19 \text{ control}}$$

Figure 69A:
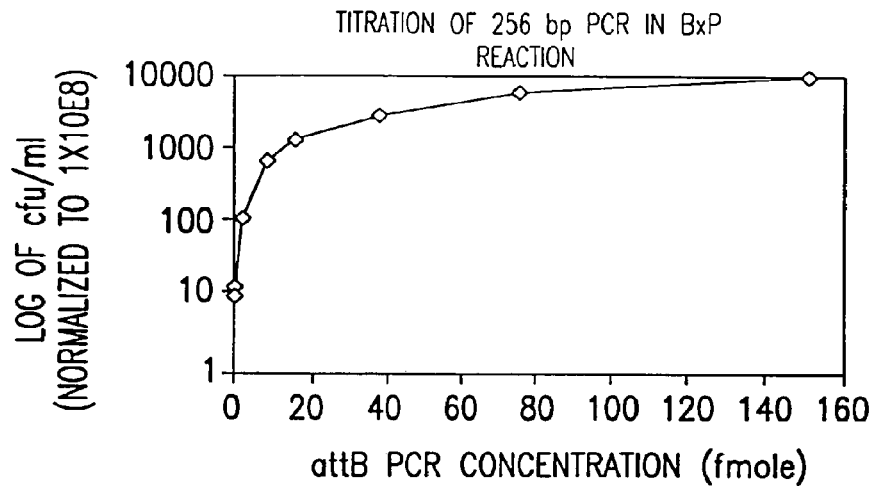
FIG. 69 is a series of graphs showing the effects of various weights (FIG. 69A) or moles (FIG. 69B) of a 256 bp PCR product on formation of colonies, and on efficiency of cloning of the 256 bp PCR product into a Donor Vector (FIG. 69C).
Figure 69B:
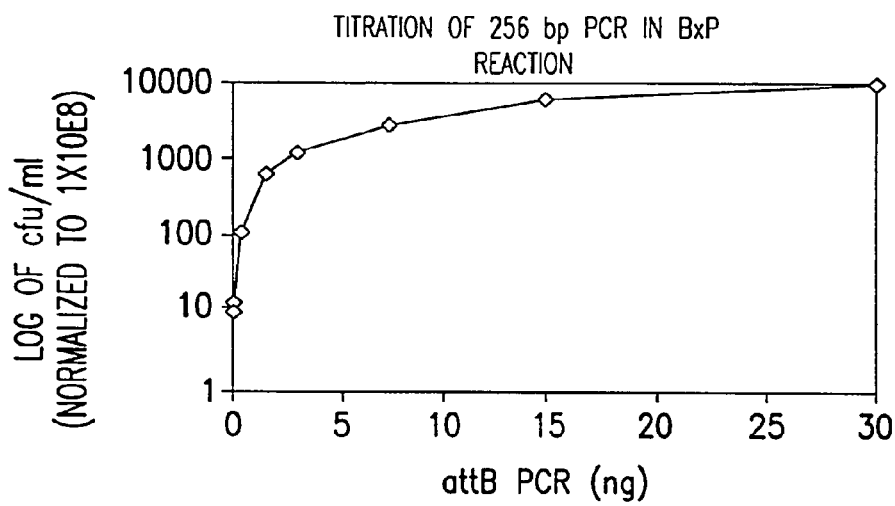
Figure 69C:
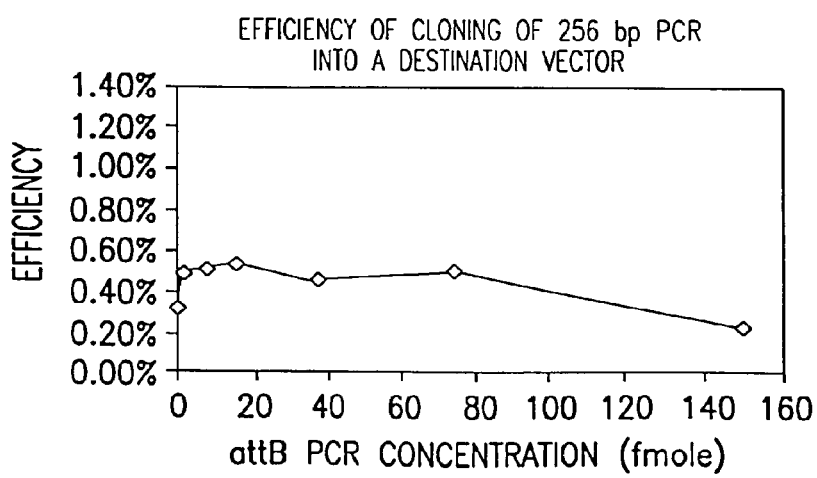
Figure 70A:
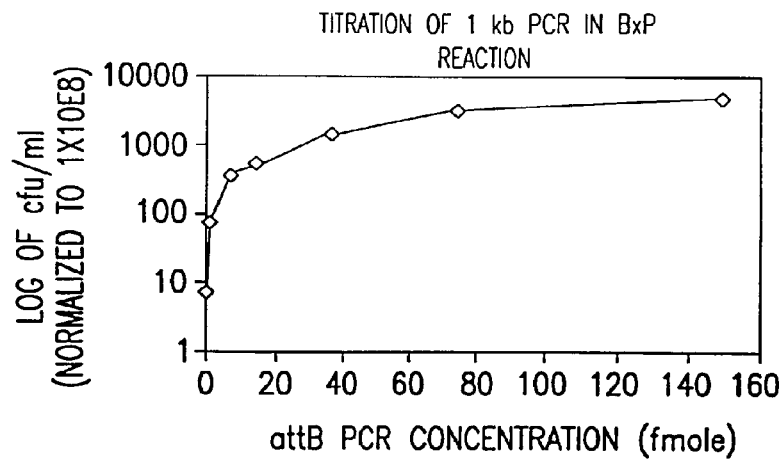
FIG. 70 is a series of graphs showing the effects of various weights (FIG. 70A) or moles (FIG. 70B) of a 1 kb PCR product on formation of colonies, and on efficiency of cloning of the 1 kb PCR product into a Donor Vector (FIG. 70C).
Figure 70B:
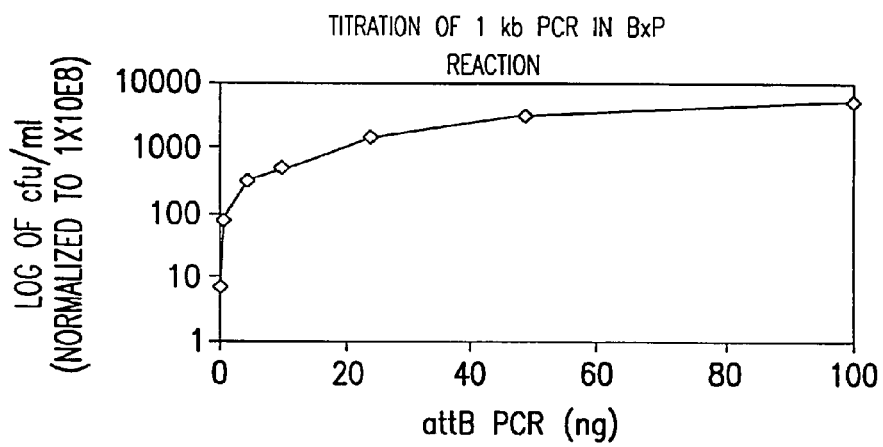
Figure 70C:
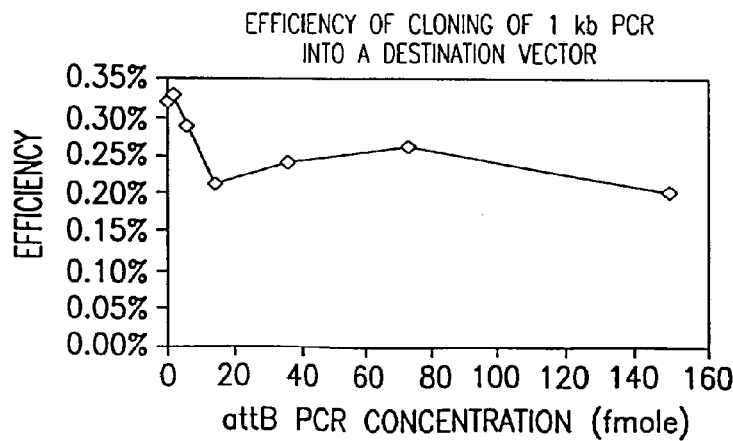
Figure 71A:
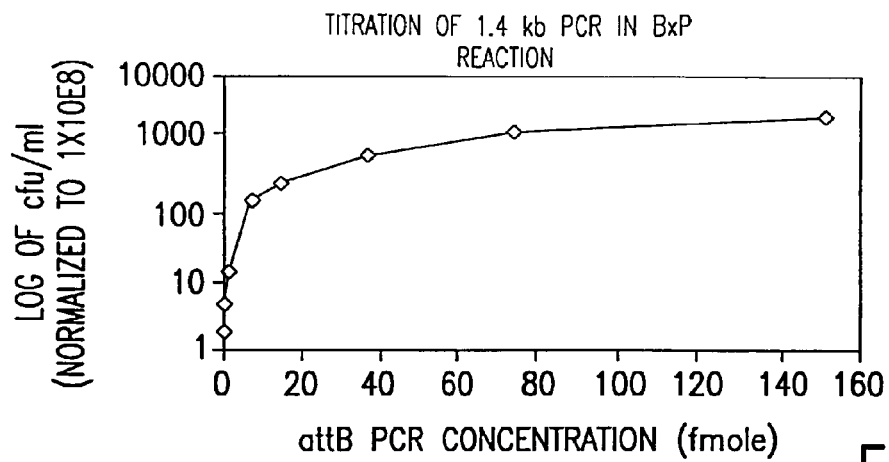
FIG. 71 is a series of graphs showing the effects of various weights (FIG. 71A) or moles (FIG. 71B) of a 1.4 kb PCR product on formation of colonies, and on efficiency of cloning of the 1.4 kb PCR product into a Donor Vector (FIG. 71C).
Figure 71B:
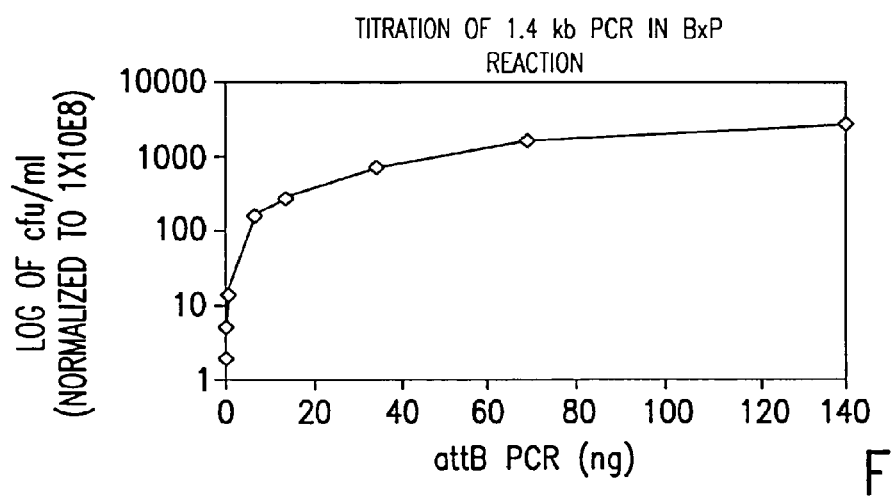
Figure 71C:
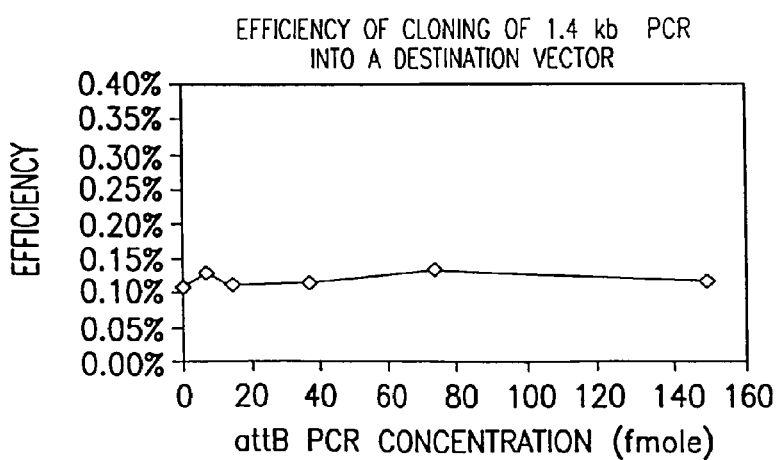
Figure 72A:
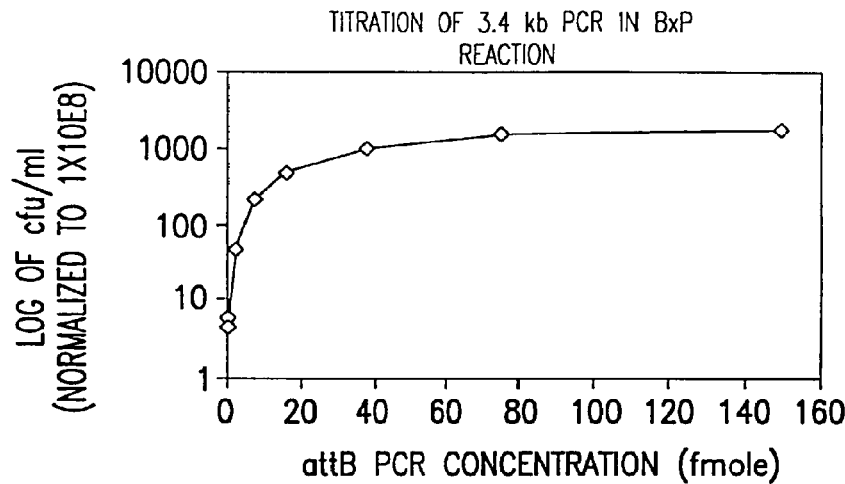
FIG. 72 is a series of graphs showing the effects of various weights (FIG. 72A) or moles (FIG. 72B) of a 3.4 kb PCR product on formation of colonies, and on efficiency of cloning of the 3.4 kb PCR product into a Donor Vector (FIG. 72C).
Figure 72B:
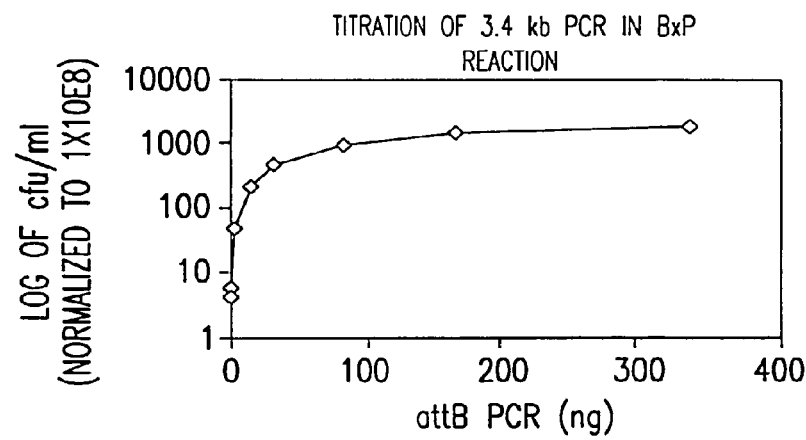
Figure 72C:
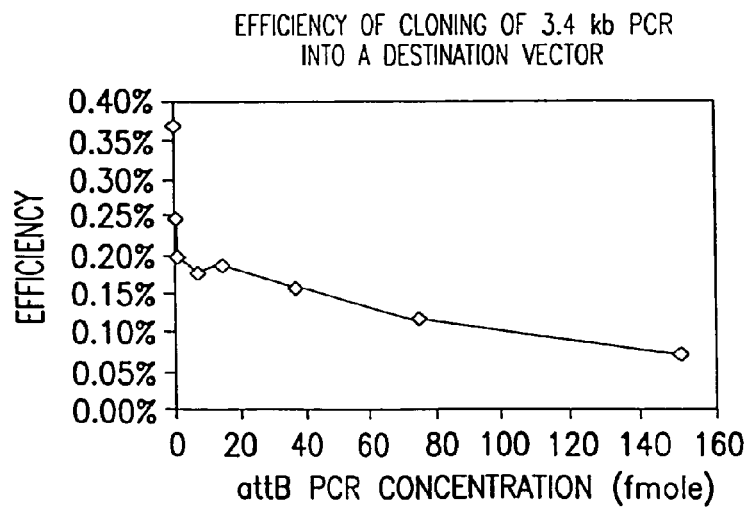
Figure 73A:
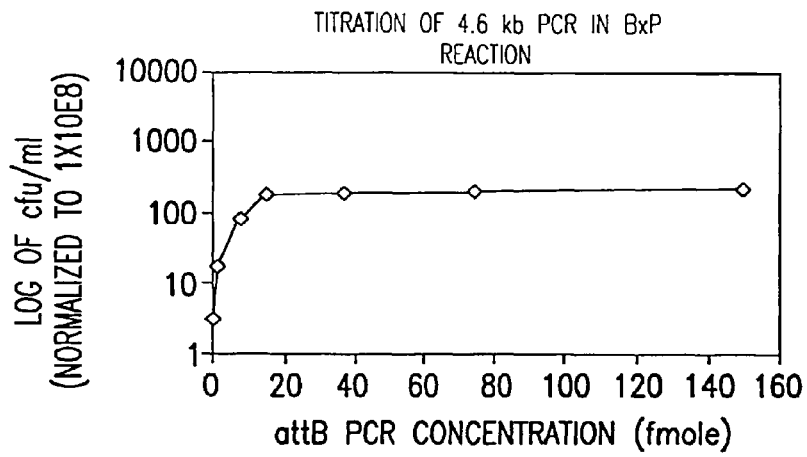
FIG. 73 is a series of graphs showing the effects of various weights (FIG. 73A) or moles (FIG. 73B) of a 4.6 kb PCR product on formation of colonies, and on efficiency of cloning of the 4.6 kb PCR product into a Donor Vector (FIG. 73C).
Figure 73B:
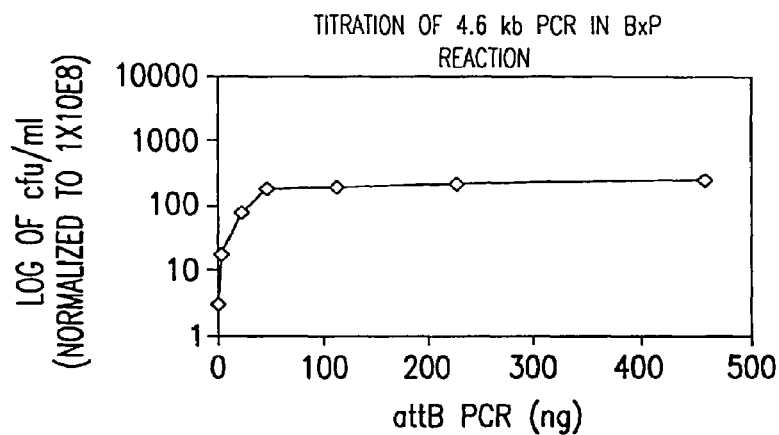
Figure 73C:
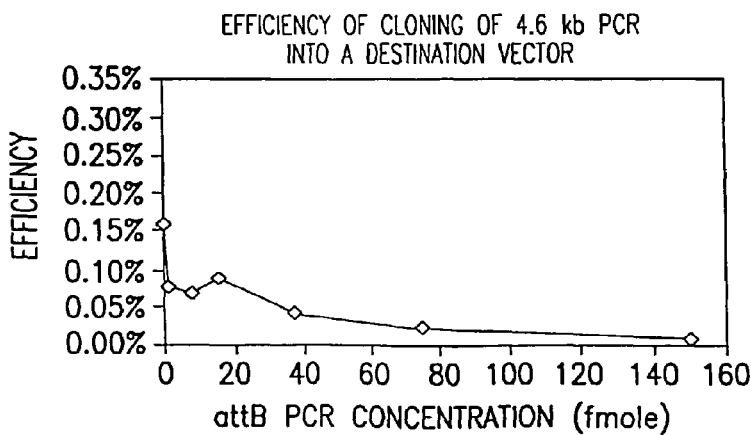
Figure 74:
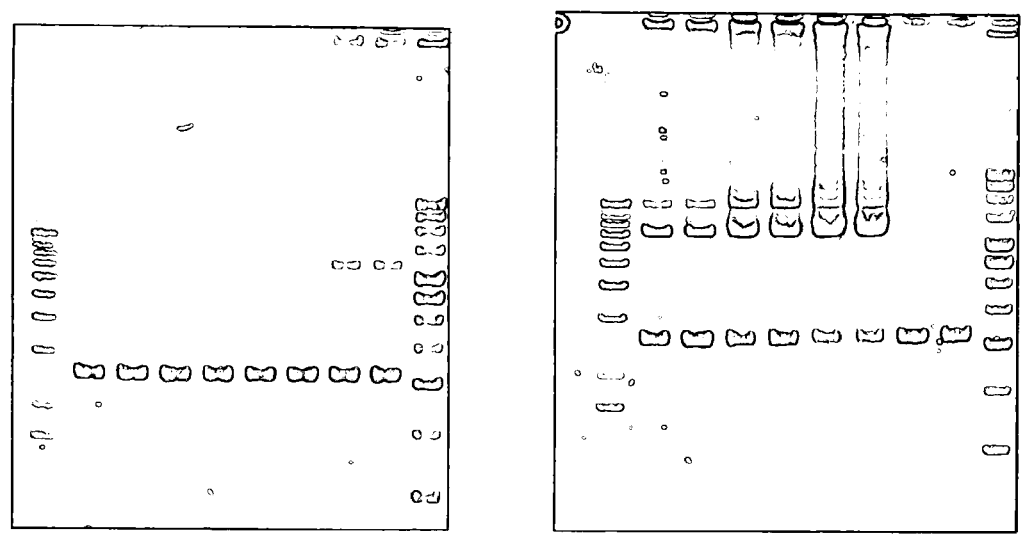
FIG. 74 is photograph of an ethidium bromide-stained gel of a titration of a 6.9 kb PCR product in a B×P reaction.
Figure 75:
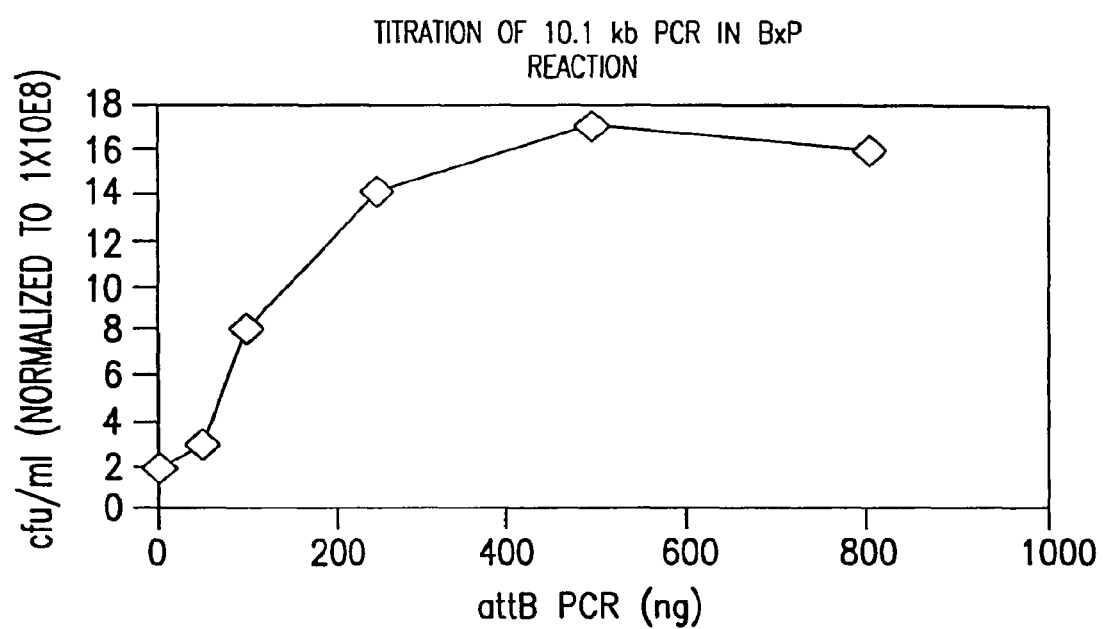
FIG. 75 is a graph showing the effects of various amounts of a 10.1 kb PCR product on formation of colonies upon cloning of the 10.1 kb PCR product into a Donor Vector.
Figure 76:
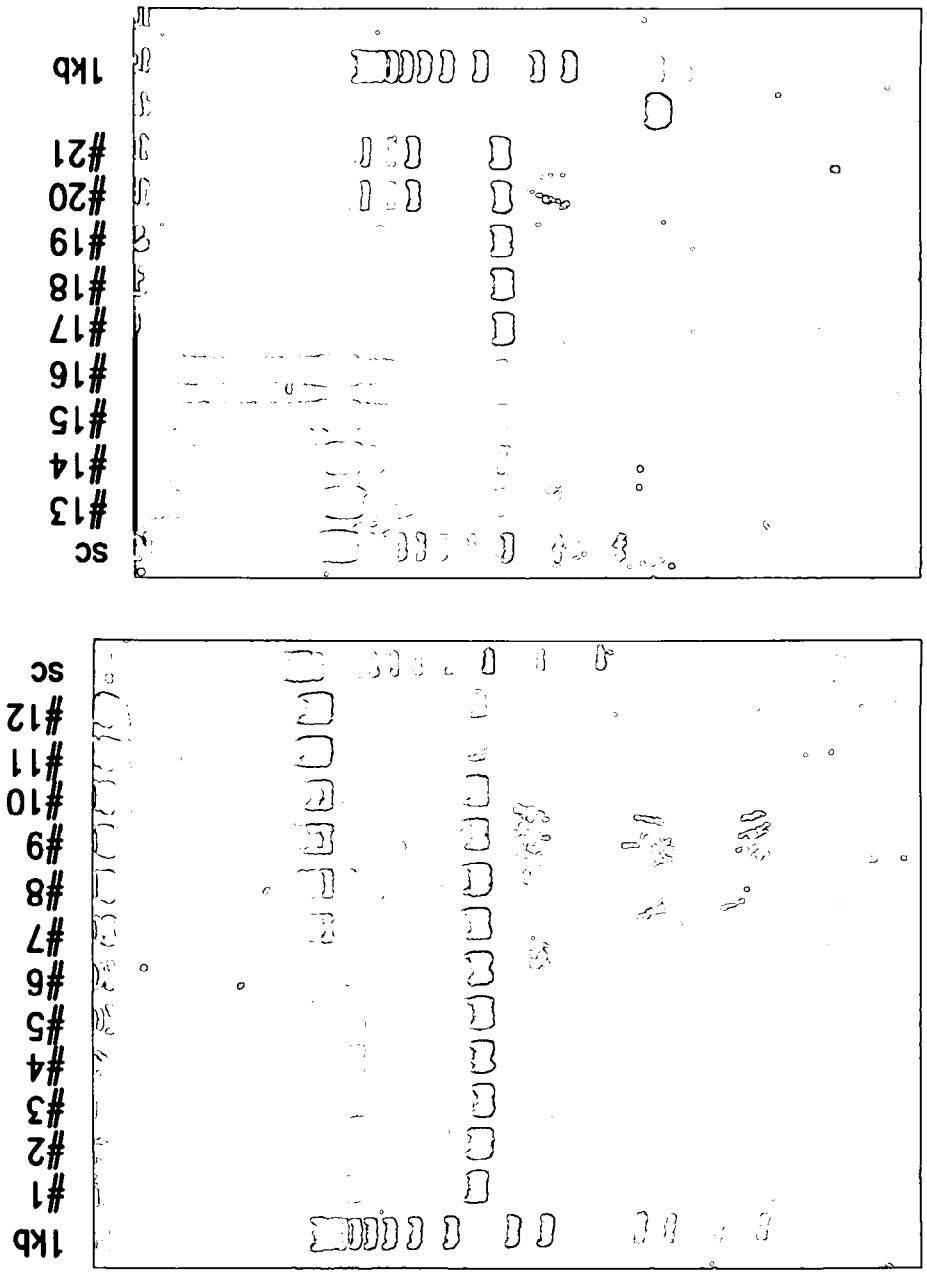
FIG. 76 is photograph of an ethidium bromide-stained gel of a titration of a 10.1 kb PCR product in a B×P reaction.

The results of these experiments are depicted in FIGS. 69A-69C (for 256 bp PCR fragments), 70A-70C (for 1 kb PCR fragments), 71A-71C (for 1.4 kb PCR fragments), 72A-72C (for 3.4 kb PCR fragments), 73A-73C (for 4.6 kb PCR fragments), 74 (for 6.9 kb PCR fragments), and 75-76 (for 10.1 kb PCR fragments). The results shown in these figures are summarized in FIG. 77, for different weights and moles of input PCR DNA.

Together, these results demonstrate that attB-containing PCR products ranging in size from about 0.25 kb to about 5 kb clone relatively efficiently in the recombinational cloning system of the invention. While PCR products larger than about 5 kb clone less efficiently (apparently due to slow resolution of cointegrates), longer incubation times during the recombination reaction appears to improve the efficiency of cloning of these larger PCR fragments. Alternatively, it may also be possible to improve efficiency of cloning of large (>about 5 kb) PCR fragments by using lower levels of input attP Donor plasmid and perhaps attB-containing PCR product, and/or by adjusting reaction conditions (e.g., buffer conditions) to favor more rapid resolution of the cointegrates.

Example 10

The BP Reaction

One purpose of the Gateward ("Entry") reaction is to convert an Expression Clone into an Entry Clone. This is useful when you have isolated an individual Expression Clone from an Expression Clone cDNA library, and you wish to transfer the nucleic acid molecule of interest into another Expression Vector, or to move a population of molecules from an attB or attL library. Alternatively, you may have mutated an Expression Clone and now wish to transfer the mutated nucleic acid molecule of interest into one or more new Expression Vectors. In both cases, it is necessary first to convert the nucleic acid molecule of interest to an Entry Clone.

Materials Needed:
- 5×BP Reaction Buffer
- Expression Clone DNA, 100-300 ng in $\leqq 8$ μl TE.
- Donor (attP) Vector, 75 ng/μl, supercoiled DNA
- Positive control attB-tet-PCR DNA, 25 ng/μl
- GATEWAY™ BP Clonase™ Enzyme Mix (stored at −80° C.)
- Clonase Stop Solution (Proteinase K, 2 μl/μl).

Notes:
Preparation of the Expression Clone DNA: Miniprep DNA Treated with Rnase works well.

1. As with the LR Reaction (see Example 14), the BP Reaction is strongly influenced by the topology of the reacting DNAs. In general, the reaction is most efficient when one of the DNAs is linear and the other is supercoiled, compared to reactions where the DNAs are both linear or both supercoiled. Further, linearizing the attB Expression Clone (anywhere within the vector) will usually give more colonies than linearizing the Donor (attP) Plasmid. If finding a suitable cleavage site within your Expression Clone vector proves difficult, you may linearize the Donor (attP) Plasmid between the attP1 and attP2 sites (for example, at the NcoI site), avoiding the ccdB gene. Maps of Donor (attP) Plasmids are given in FIGS. 49-54.

Procedure:
1. Assemble reactions as follows. Combine all components at room temperature, except GATEWAY™ BP Clonase™ Enzyme Mix, before removing GATEWAY™ BP Clonase™ Enzyme Mix from freezer.

| Component | Neg. Tube 1 | Pos. Tube 2 | Test Tube 3 |
|---|---|---|---|
| Positive Control, attB-tet-PCR DNA, 25 ng/μl | 4 μl | 4 μl | |
| Desired attB Expression Clone DNA (100 ng) linearized | | | 1-8 μl |
| Donor (attP) Plasmid, 75 ng/μl | 2 μl | 2 μl | 2 μl |
| 5× BP Reaction Buffer | 4 μl | 4 μl | 4 μl |
| TE | 10 μl | 6 μl | To 16 μl |
| GATEWAY ™ BP Clonase ™ Enzyme Mix (store at −80° C., add last) | — | 4 μl | 4 μl |
| Total Volume | 20 μl | 20 μl | 20 μl |

2. Remove the GATEWAY™ BP Clonase™ Enzyme Mix from the −80° C. freezer, place immediately on ice. The mixture takes only a few minutes to thaw.
3. Add 4 μl of GATEWAY™ BP Clonase™ Enzyme Mix to the subcloning reaction, mix.
4. Return GATEWAY™ BP Clonase™ Enzyme Mix to −80° C. freezer.
5. Incubate tubes at 25° for at least 60 minutes. If both the attB and attP DNAs are supercoiled, incubation for 2-24 hours at 25° C. is recommended.
6. Add 2 μl Clonase Stop Solution. Incubate for 10 min at 37° C.
7. Transform 2 μl into 100 μl competent *E. coli*, as above. Select on LB plates containing 50 μg/ml kanamycin.

Example 11

Cloning PCR Products into Entry Vectors Using Standard Cloning Methods

Preparation of Entry Vectors for Cloning of PCR Products

All of the Entry Vectors of the invention contain the death gene ccdB as a stuffer between the "left" and "right" restriction sites. The advantage of this arrangement is that there is virtually no background from vector that has not been cut with both restriction enzymes, because the presence of the ccdB gene will kill all standard *E. coli* strains. Thus it is necessary to cut each Entry Vector twice, to remove the ccdB fragment.

We strongly recommend that, after digestion of the Entry Vector with the second restriction enzyme, you treat the reaction with phosphatase (calf intestine alkaline phosphatase, CIAP or thermosensitive alkaline phosphatase, TSAP). The phosphatase can be added directly to the reaction mixture, incubated for an additional time, and inactivated. This step dephosphorylates both the vector and ccdB fragments, so that during subsequent ligation there is less competition between the ccdB fragment and the DNA of interest for the termini of the Entry Vector.

Blunt Cloning of PCR Products

Generally PCR products do not have 5' phosphates (because the primers are usually 5' OH), and they are not necessarily blunt. (On this latter point, see Brownstein, et al., *BioTechniques* 20: 1006, 1996 for a discussion of how the sequence of the primers affects the addition of single 3' bases.) The following protocol repairs these two defects.

In a 0.5 ml tube, ethanol precipitate about 40 ng of PCR product (as judged from an agarose gel).
1. Dissolve the precipitated DNA in 10 μl comprising 1 μl 10 mM rATP, 1 μl mixed 2 mM dNTPs (i.e., 2 mM each dATP, dCTP, dTTP, and dGTP), 2 μl 5× T4 polynucleotide kinase buffer (350 mM Tris HCl (pH7.6), 50 mM $MgCl_2$, 500 mM KCl, 5 mM 2-mercaptoethanol) 10 units T4 polynucleotide kinase, 1 μl T4 DNA polymerase, and water to 10 μl.
2. Incubate the tube at 37° for 10 minutes, then at 65° for 15 minutes, cool, centrifuge briefly to bring any condensate to the tip of the tube.
3. Add 5 μl of the PEG/$MgCl_2$ solution, mix and centrifuge at room temperature for 10 minutes. Discard supernatant.
4. Dissolve the invisible precipitate in 10 μl containing 2 μl 5×T4 DNA ligase buffer (Life Technologies, Inc.), 0.5 units T4 DNA ligase, and about 50 ng of blunt, phosphatase-treated Entry Vector.
5. Incubate at 25° for 1 hour, then 65° for 10 minutes. Add 90 μl TE, transform 10 μl into 50-100 μl competent *E. coli* cells.
6. Plate on kanamycin.

Note: In the above protocol, steps b-c simultaneously polish the ends of the PCR product (through the exonuclease and polymerase activities of T4 DNA polymerase) and phosphorylate the 5' ends (using T4 polynucleotide kinase). It is necessary to inactivate the kinase, so that the blunt, dephosphorylated vector in step e cannot self ligate. Step d (the PEG precipitation) removes all small molecules (primers, nucleotides), and has also been found to improve the yield of cloned PCR product by 50 fold.

Cloning PCR Products after Digestion with Restriction Enzymes

Efficient cloning of PCR products that have been digested with restriction enzymes includes three steps: inactivation of Taq DNA polymerase, efficient restriction enzyme cutting, and removal of small DNA fragments.

Inactivation of Taq DNA Polymerase: Carryover of Taq DNA polymerase and dNTPs into a RE digestion significantly reduces the success in cloning a PCR product (D. Fox et al., FOCUS 20(1):15, 1998), because Taq DNA polymerase can fill in sticky ends and add bases to blunt ends. Either TAQQUENCH™ (obtainable from Life Technologies, Inc.; Rockville, Md.) or extraction with phenol can be used to inactivate the Taq.

Efficient Restriction Enzyme Cutting: Extra bases on the 5' end of each PCR primer help the RE cut near ends of PCR products. With the availability of cheap primers, adding 6 to 9 bases on the 5' sides of the restriction sites is a good investment to ensure that most of the ends are digested. Incubation of the DNA with a 5-fold excess of restriction enzyme for an hour or more helps ensure success.

Removal of Small Molecules before Ligation: Primers, nucleotides, primer dimers, and small fragments produced by the restriction enzyme digestion, can all inhibit or compete with the desired ligation of the PCR product to the cloning vector. This protocol uses PEG precipitation to remove small molecules.

Protocol for Cutting the Ends of PCR Products with Restriction Enzyme(s):

1. Inactivation of Taq DNA polymerase in the PCR product:

Option A: Extraction with Phenol
- A1. Dilute the PCR reaction to 200 µl with TE. Add an equal volume of phenol:chloroform:isoamyl alcohol, vortex vigorously for 20 seconds, and centrifuge for 1 minute at room temperature. Discard the lower phase.
- A2. Extract the phenol from the DNA and concentrate as follows. Add an equal volume of 2-butanol (colored red with "Oil Red O" from Aldrich, if desired), vortex briefly, centrifuge briefly at room temperature. Discard the upper butanol phase. Repeat the extraction with 2-butanol. This time the volume of the lower aqueous phase should decrease significantly. Discard the upper 2-butanol phase.
- A3. Ethanol precipitate the DNA from the aqueous phase of the above extractions. Dissolve in a 200 µl of a suitable restriction enzyme (RE) buffer.

Option B: Inactivation with TaqQuench
- B1. Ethanol precipitate an appropriate amount of PCR product (100 ng to 1 µg), dissolve in 200 µl of a suitable RE buffer.
- B2. Add 2 µl TaqQuench.

2. Add 10 to 50 units of restriction enzyme and incubate for at least 1 hour. Ethanol precipitate if necessary to change buffers for digestion at the other end of the PCR product.

3. Add ½ volume of the PEG/MgCl$_2$ mix to the RE digestion. Mix well and immediately centrifuge at room temperature for 10 minutes. Discard the supernatant (pellet is usually invisible), centrifuge again for a few seconds, discard any remaining supernatant.

4. Dissolve the DNA in a suitable volume of TE (depending on the amount of PCR product in the original amplification reaction) and apply an aliquot to an agarose gel to confirm recovery. Apply to the same gel 20-100 ng of the appropriate Entry Vector that will be used for the cloning.

Example 12

Determining the Expected Size of the GATEWAY™ Cloning Reaction Products

If you have access to a software program that will electronically cut and splice sequences, you can create electronic clones to aid you in predicting the sizes and restriction patterns of GATEWAY™ Cloning System recombination products.

The cleavage and ligation steps performed by the enzyme Int in the GATEWAY™ Cloning System recombination reactions mimic a restriction enzyme cleavage that creates a 7-bp 5'-end overhang followed by a ligation step that reseals the ends of the daughter molecules. The recombination proteins present in the Clonase cocktails (see Example 19 below) recognize the 15 bp core sequence present within all four types of att sites (in addition to other flanking sequences characteristic of each of the different types of att sites).

By treating these sites in your software program as if they were restriction sites, you can cut and splice your Entry Clones with various Destination Vectors and obtain accurate maps and sequences of the expected results from your GATEWAY™ Cloning System reactions.

Example 13

Protein Expression

Brief Review of Protein Expression

Transcription: The most commonly used promoters in E. coli Expression Vectors are variants of the lac promoter, and these can be turned on by adding IPTG to the growth medium. It is usually good to keep promoters off until expression is desired, so that the host cells are not made sick by the overabundance of some heterologous protein. This is reasonably easy in the case of the lac promoters used in E. coli. One needs to supply the lac I gene (or its more productive relative, the lac I$^q$ gene) to make lac repressor protein, which binds near the promoter and keeps transcription levels low. Some Destination Vectors for E. coli expression carry their own lacI$^q$ gene for this purpose. (However, lac promoters are always a little "on," even in the absence of IPTG.)

Controlling transcription in eukaryotic cells is not nearly so straightforward or efficient. The tetracycline system of Bujard and colleagues is the most successful approach, and one of the Destination Vectors (pDEST11; FIG. 31) has been constructed to supply this function.

Translation: Ribosomes convert the information present in mRNA into protein. Ribosomes scan RNA molecules looking for methionine (AUG) codons, which begin nearly all nascent proteins. Ribosomes must, however, be able to distinguish between AUG codons that code for methionine in the middle of proteins from those at the start. Most often ribosomes choose AUGs that are 1) first in the RNA (toward the 5' end), and 2) have the proper sequence context. In E. coli the favored context (first recognized by Shine and Dalgarno, Eur. J. Biochem. 57: 221 (1975)) is a run of purines (As and Gs) from five to 12 bases upstream of the initiating AUG, especially AGGAGG or some variant.

In eukaryotes, a survey of translated mRNAs by Kozak (J. Biol. Chem. 266: 19867 (1991)) has revealed a preferred sequence context, gcc Acc ATGG (SEQ ID NO: 295), around the initiating methionine, with the A at −3 being most important, and a purine at +4 (where the A of the ATG is +1), preferably a G, being next most influential. Having an A at −3 is enough to make most ribosomes choose the first AUG of an mRNA, in plants, insects, yeast, and mammals. (For a review of initiation of protein synthesis in eukaryotic cells, see: Pain, V. M. Eur. J. Biochem. 236:747-771, 1996.)

Consequences of Translation Signals for GATEWAY™ Cloning System: First, translation signals (Shine-Dalgarno in *E. coli*, Kozak in eukaryotes) have to be close to the initiating ATG. The attB site is 25 base pairs long. Thus if translation signals are desired near the natural ATG of the nucleic acid molecule of interest, they must be present in the Entry Clone of that nucleic acid molecule of interest. Also, when a nucleic acid molecule of interest is moved from an Entry Clone to a Destination vector, any translation signals will move along. The result is that the presence or absence of Shine-Dalgarno and/or Kozak sequences in the Entry Clone must be considered, with the eventual Destination Vectors to be used in mind.

Second, although ribosomes choose the 5' ATG most often, internal ATGs are also used to begin protein synthesis. The better the translation context around this internal ATG, the more internal translation initiation will be seen. This is important in the GATEWAY™ Cloning System, because you can make an Entry Clone of your nucleic acid molecule of interest, and arrange to have Shine-Dalgarno and/or Kozak sequences near the ATG. When this cassette is recombined into a Destination Vector that transcribes your nucleic acid molecule of interest, you get native protein. If you want, you can make a fusion protein in a different Destination Vector, since the Shine-Dalgarno and/or Kozak sequences do not contain any stop signals in the same reading frame. However, the presence of these internal translation signals may result in a significant amount of native protein being made, contaminating, and lowering the yield of, your fusion protein. This is especially likely with short fusion tags, like His6.

A good compromise can be recommended. If an Entry Vector like pENTR7 (FIG. 16) or pENTR8 (FIG. 17) is chosen, the Kozak bases are present for native eukaryotic expression. The context for *E. coli* translation is poor, so the yield of an amino-terminal fusion should be good, and the fusion protein can be digested with the TEV protease to make near-native protein following purification.

Recommended Conditions for Synthesis of Proteins in *E. coli*: When making proteins in *E. coli* it is advisable, at least initially, to incubate your cultures at 30° C., instead of at 37° C. Our experience indicates that proteins are less likely to form aggregates at 30° C. In addition, the yields of proteins from cells grown at 30° C. frequently are improved.

The yields of proteins that are difficult to express may also be improved by inducing the cultures in mid-log phase of growth, using cultures begun in the morning from overnight growths, as opposed to harvesting directly from an overnight culture. In the latter case, the cells are preferably in late log or stationary growth, which can favor the formation of insoluble aggregates.

Example 14

Constructing Destination Vectors from Existing Vectors

Figure 63:
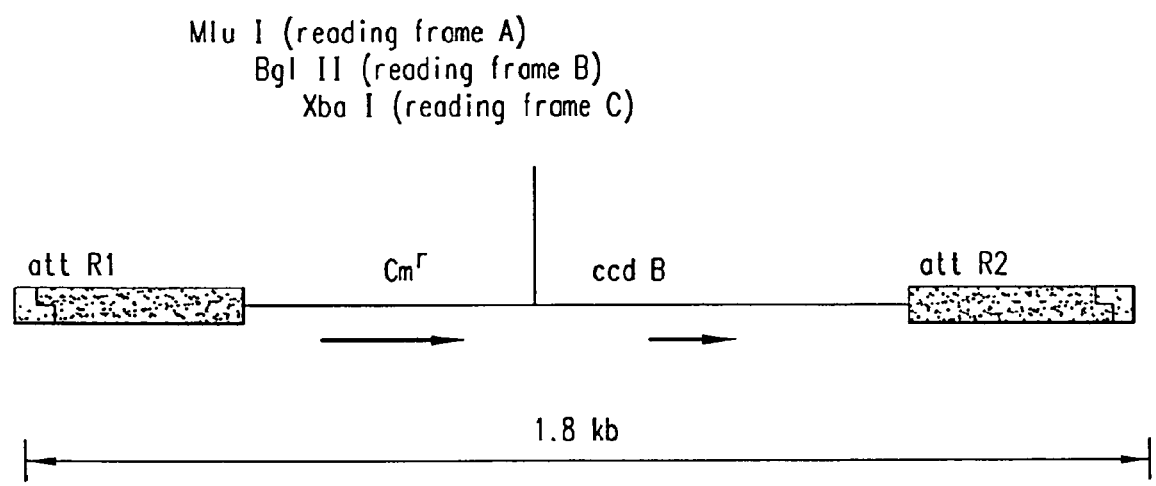
FIG. 63 is a schematic depiction of three GATEWAY™ Cloning System cassettes. Three blunt-ended cassettes are depicted which convert standard expression vectors to Destination Vectors. Each of the depicted cassettes provides amino-terminal fusions in one of three possible reading frames, and each has a distinctive restriction cleavage site as shown.
Figure 64A:
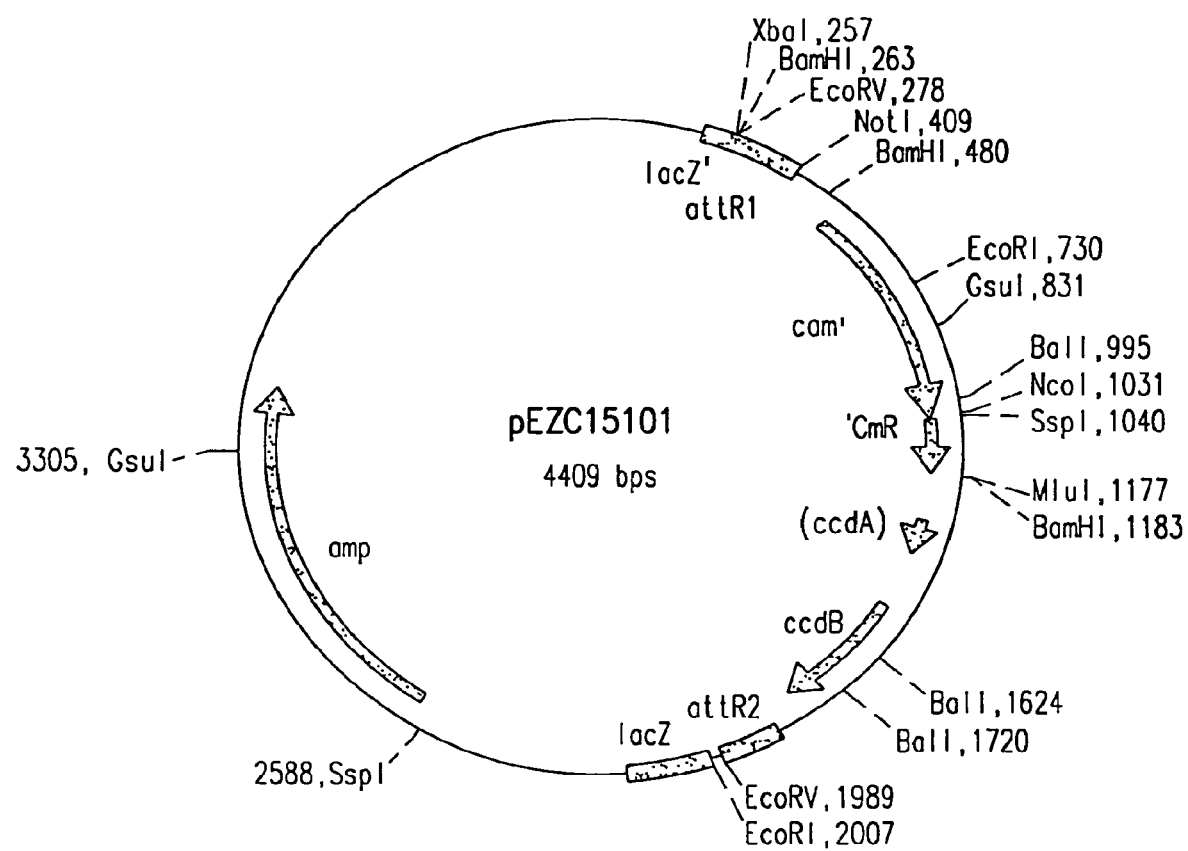
FIG. 64A), pEZC15102 (reading frame B.
Figure 64B:
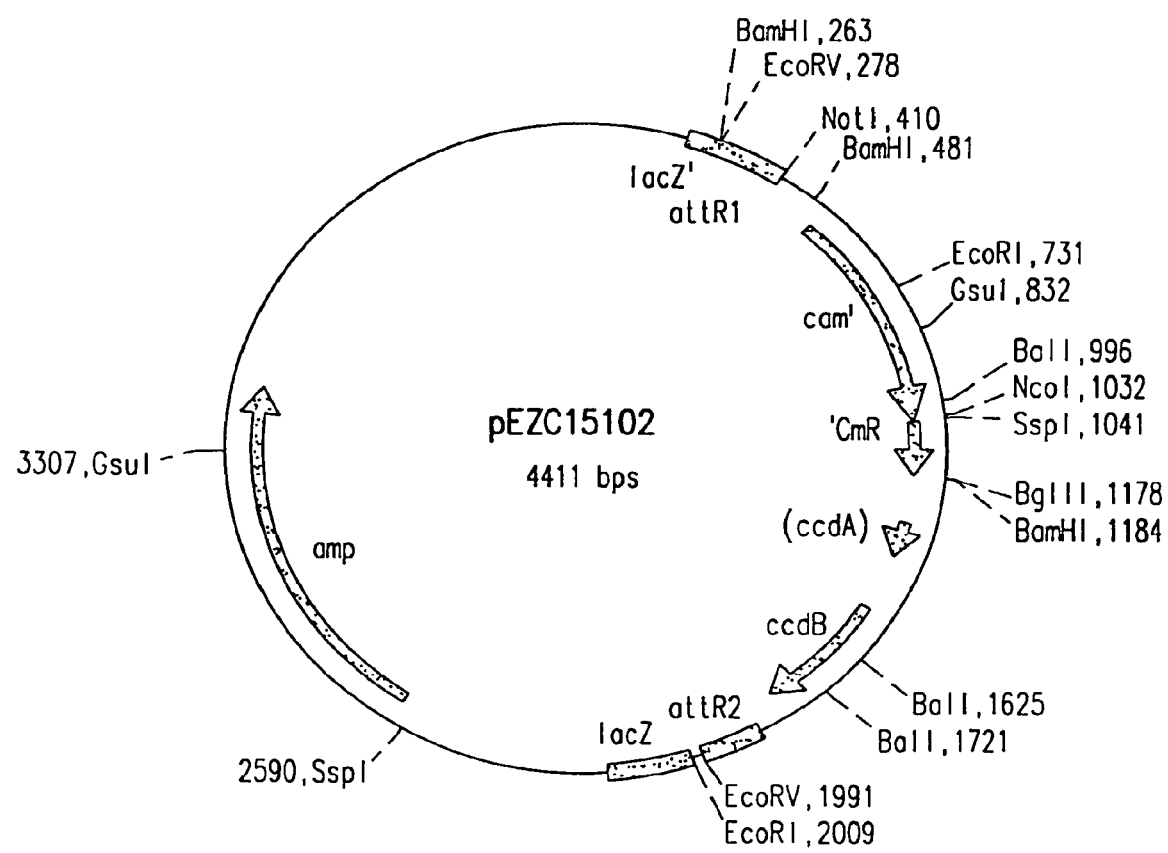
FIG. 64B), and pEZC15103 (reading frame C.
Figure 64C:
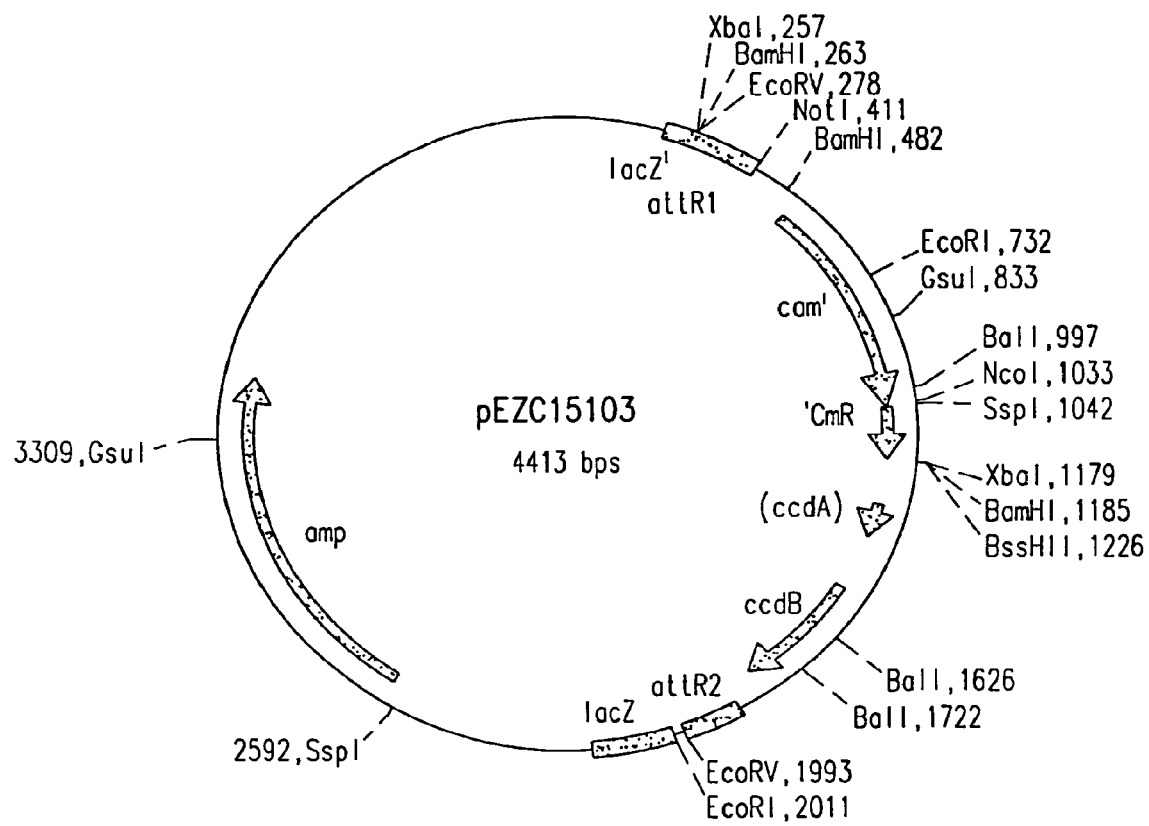
FIGS. 64C-C).

Destination Vectors function because they have two recombination sites, attR1 and attR2, flanking a chloramphenicol resistance (CmR) gene and a death gene, ccdB. The GATEWAY™ Cloning System recombination reactions exchange the entire Cassette (except for a few bases comprising part of the attB sites) for the DNA segment of interest from the Entry Vector. Because attR1, CmR, ccdB gene, and attR2 are contiguous, they can be moved on a single DNA segment. If this Cassette is cloned into a plasmid, the plasmid becomes a Destination Vector. FIG. 63 shows a schematic of the GATEWAY™ Cloning System Cassette; attR cassettes in all three reading frames contained in vectors pEZC15101, pEZC15102 and pEZC15103 are shown in FIGS. 64A, 64B, and 64C, respectively.

The protocol for constructing a Destination Vector is presented below. Keep in mind the following points:

Destination Vectors must be constructed and propagated in one of the DB strains of *E. coli* (e.g., DB3.1, and particularly *E. coli* LIBRARY EFFICIENCY® DB3.1™ Competent Cells) available from Life Technologies, Inc. (and described in detail in U.S. Provisional Application No. 60/122,392, filed on Mar. 2, 1999, which is incorporated herein by reference), because the ccdB death gene will kill any *E. coli* strain that has not been mutated such that it will survive the presence of the ccdB gene.

Figure 78:
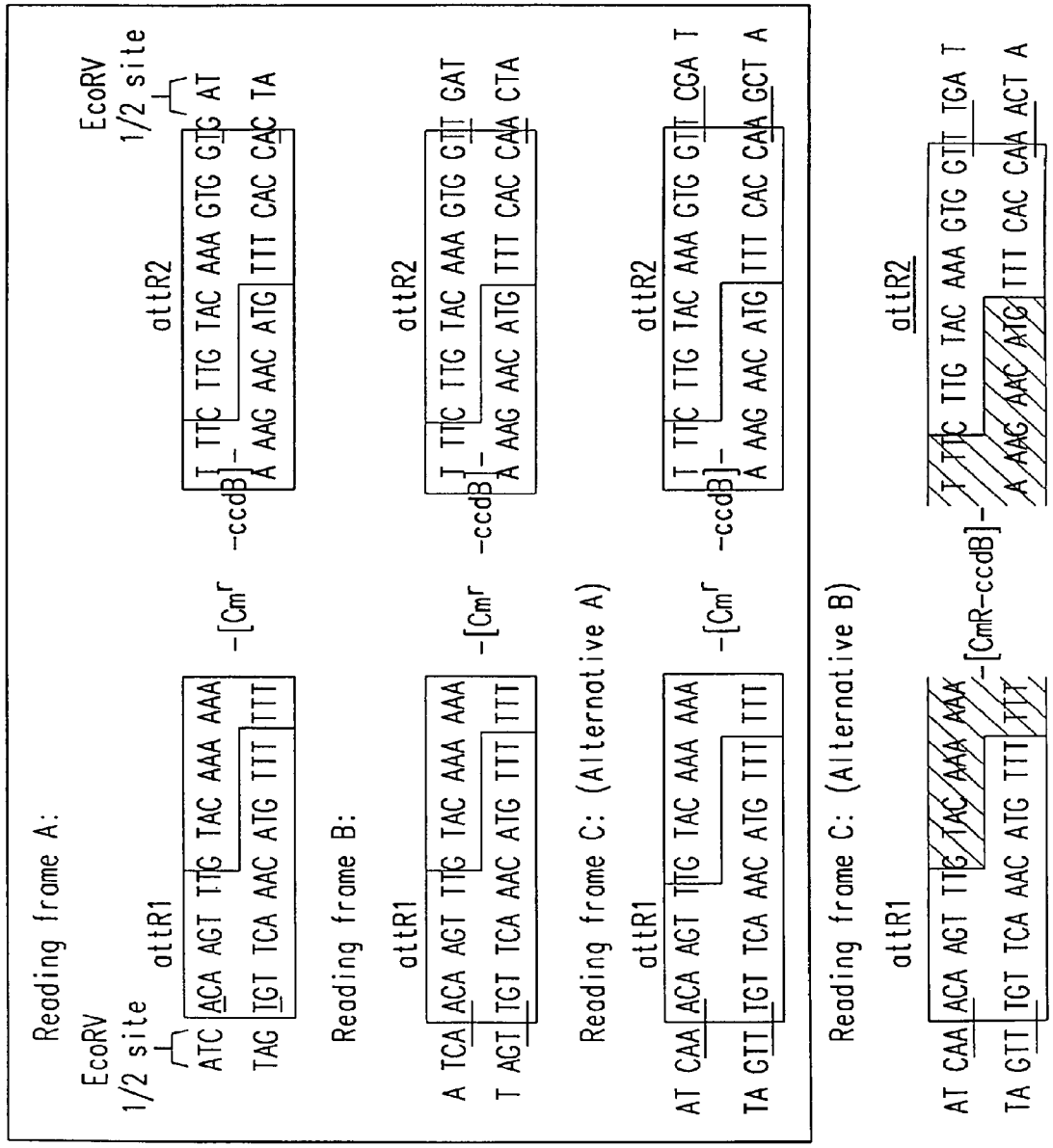
FIG. 78 is a depiction of the sequences at the ends of attR Cassettes (SEQ ID NOs:163-170). Sequences contributed by the Cm$^r$-ccdB cassette are shown, including the outer ends of the flanking attR sites (boxed). The staggered cleavage sites for Int are indicated in the boxed regions. Following recombination with an Entry Clone, only the outer sequences in attR sites contribute to the resulting attB sites in the Expression Clone. The underlined sequences at both ends dictate the different reading frames (reading frames A, B, or C, with two alternative reading frame C cassettes depicted) for fusion proteins.

If your Destination Vector will be used to make a fusion protein, a GATEWAY™ Cloning System cassette with the correct reading frame must be used. The nucleotide sequences of the ends of the cassettes are shown in FIG. 78. The reading frame of the fusion protein domain must be in frame with the core region of the attR1 site (for an amino terminal fusion) so that the six As are translated into two lysine codons. For a C-terminal fusion protein, translation through the core region of the attR2 site should be in frame with -TAC-AAA-, to yield -Tyr-Lys-.

Note that each reading frame Cassette has a different unique restriction site between the chloramphenicol resistance and ccdB genes (MluI for reading frame A, BglII for reading frame B, and XbaI for reading frame C; see FIG. 63).

Most standard vectors can be converted to Destination Vectors, by inserting the Entry Cassette into the MCS of that vector.

Protocol for Making a Destination Vector

1. If the vector will make an amino fusion protein, it is necessary to keep the "aaa aaa" triplets in attR1 in phase with the triplets of the fusion protein. Determine which Entry cassette to use as follows:

a.) Write out the nucleotide sequence of the existing vector near the restriction site into which the Entry cassette will be cloned. These must be written in triplets corresponding to the amino acid sequence of the fusion domain.

b.) Draw a vertical line through the sequence that corresponds to the restriction site end, after it has been cut and made blunt, i.e., after filling in a protruding 5' end or polishing a protruding 3' end.

c.) Choose the appropriate reading frame cassette:
If the coding sequence of the blunt end ends after a complete codon triplet, use the reading frame A cassette. See FIGS. 78, 79 and 80.
If the coding sequence of the blunt end ends in a single base, use the reading frame B cassette. See FIGS. 78, 79 and 81.
If the coding sequence of the blunt end ends in two bases, use the reading frame C cassette. See FIGS. 78, 79, 82A-B, and 83A-C.

2. Cut one to five micrograms of the existing plasmid at the position where you wish your nucleic acid molecule of interest (flanked by att sites) to be after the recombination reactions. Note: it is better to remove as many of the MCS restriction sites as possible at this step. This makes it more likely that restriction enzyme sites within the GATEWAY™ Cloning System Cassette will be unique in the new plasmid, which is important for linearizing the Destination Vector (Example 14, below).

3. Remove the 5' phosphates with alkaline phosphatase. While this is not mandatory, it increases the probability of success.
4. Make the end(s) blunt with fill-in or polishing reactions. For example, to 1 µg of restriction enzyme-cut, ethanol-precipitated vector DNA, add:
   i. 20 µl 5×T4 DNA Polymerase Buffer (165 mM Trisacetate (pH 7.9), 330 mM Na acetate, 50 mM Mg acetate, 500 µg/ml BSA, 2.5 mM DTT)
   ii. 5 µl 10 mM dNTP mix
   iii. 1 Unit of T4 DNA Polymerase
   iv. Water to a final volume of 100 µl
   v. Incubate for 15 min at 37° C.
5. Remove dNTPs and small DNA fragments: Ethanol precipitate (add three volumes of room temperature ethanol containing 0.1 M sodium acetate, mix well, immediately centrifuge at room temperature 5-10 minutes), dissolve wet precipitate in 200 µl TE, add 100 µl 30% PEG 8000, 30 mM MgCl$_2$, mix well, immediately centrifuge for 10 minutes at room temperature, discard supernatant, centrifuge again a few seconds, discard any residual liquid.
6. Dissolve the DNA to a final concentration of 10-50 ng per microliter. Apply 20-100 ng to a gel next to supercoiled plasmid and linear size standards to confirm cutting and recovery. The cutting does not have to be 100% complete, since you will be selecting for the chloramphenicol marker on the Entry cassette.
7. In a 10 µl ligation reaction combine 10-50 ng vector, 10-20 ng of Entry Cassette (FIG. 79), and 0.5 units T4 DNA ligase in ligase buffer. After one hour (or overnight, whichever is most convenient), transform 1 µl into one of the DB strains of competent *E. coli* cells with a gyrA462 mutation (See U.S. Provisional Application No. 60/122,392, filed on Mar. 2, 1999, which is incorporated herein by reference), preferably DB3.1, and most preferably *E. coli* LIBRARY EFFICIENCY® DB3.1™ Competent Cells. The ccdB gene on the Entry Cassette will kill other strains of *E. coli* that have not been mutated so as to survive the presence of the ccdB gene.
8. After expression in SOC medium, plate 10 µl and 100 µl on chloramphenicol-containing (30 µg/ml) plates, incubate at 37° C.
9. Pick colonies, make miniprep DNA. Treat the miniprep with RNase A and store in TE. Cut with the appropriate restriction enzyme to determine the orientation of the Cassette. Choose clones with the attR1 site next to the amino end of the protein expression function of the plasmid.

Figure 80:
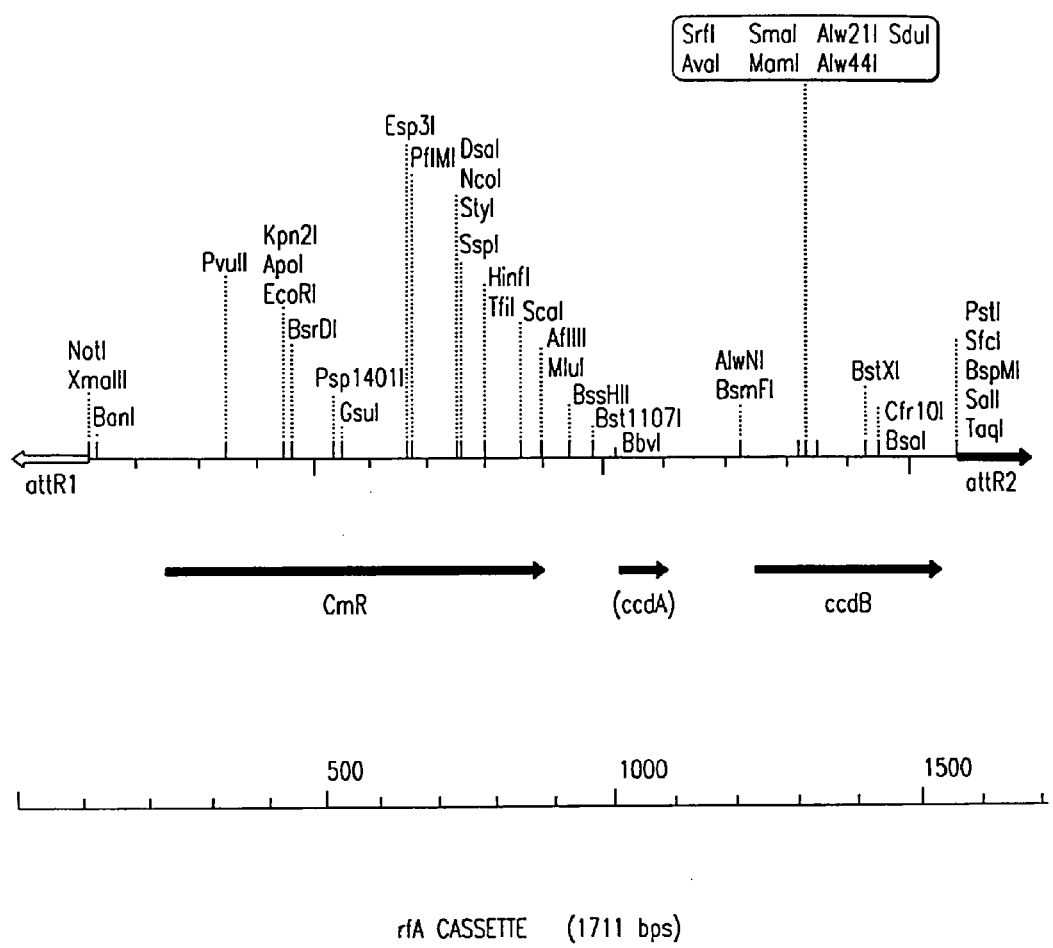
FIG. 80 illustrates the single-cutting restriction sites in an attR reading frame A cassette of the invention.
Figure 81:
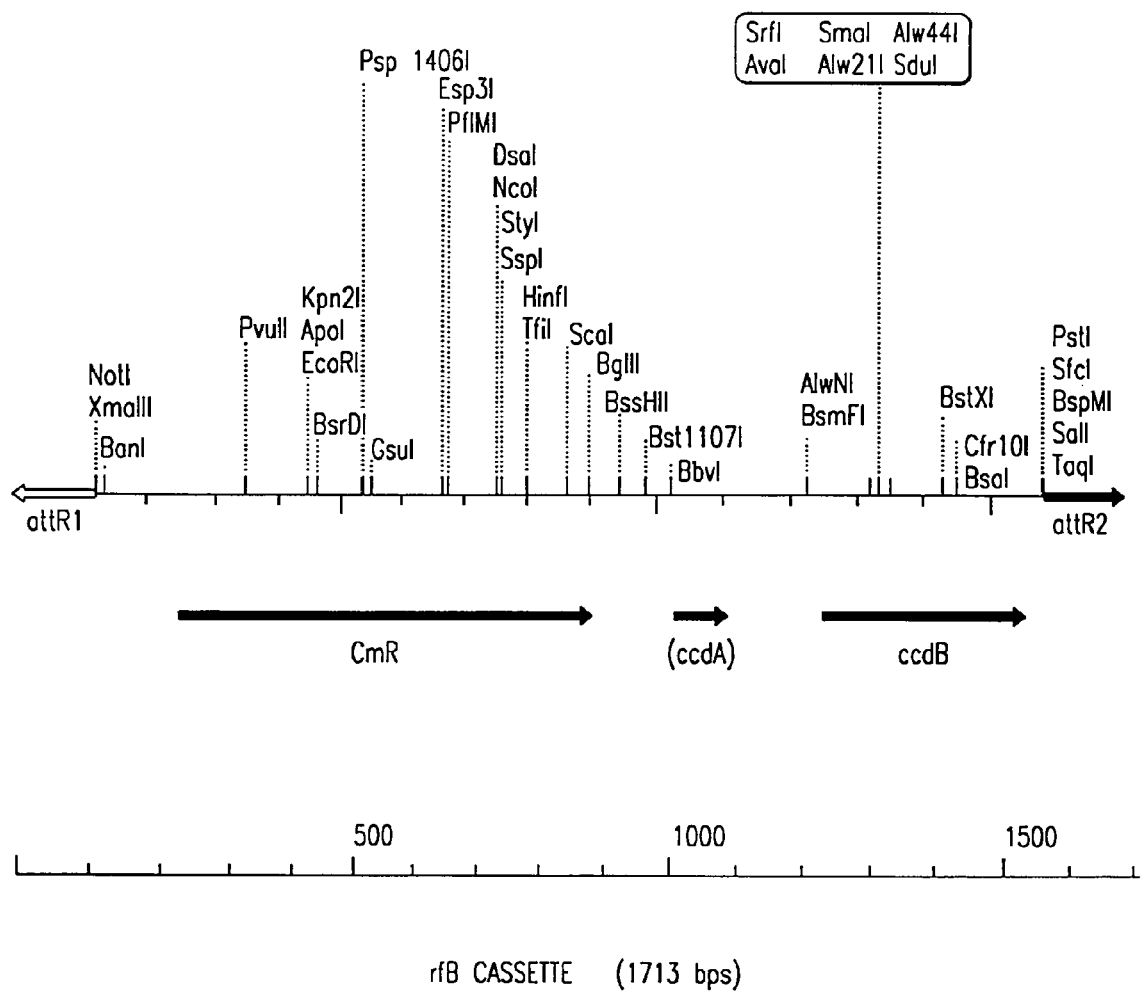
FIG. 81 illustrates the single-cutting restriction sites in an attR reading frame B cassette of the invention.
Figure 82A:
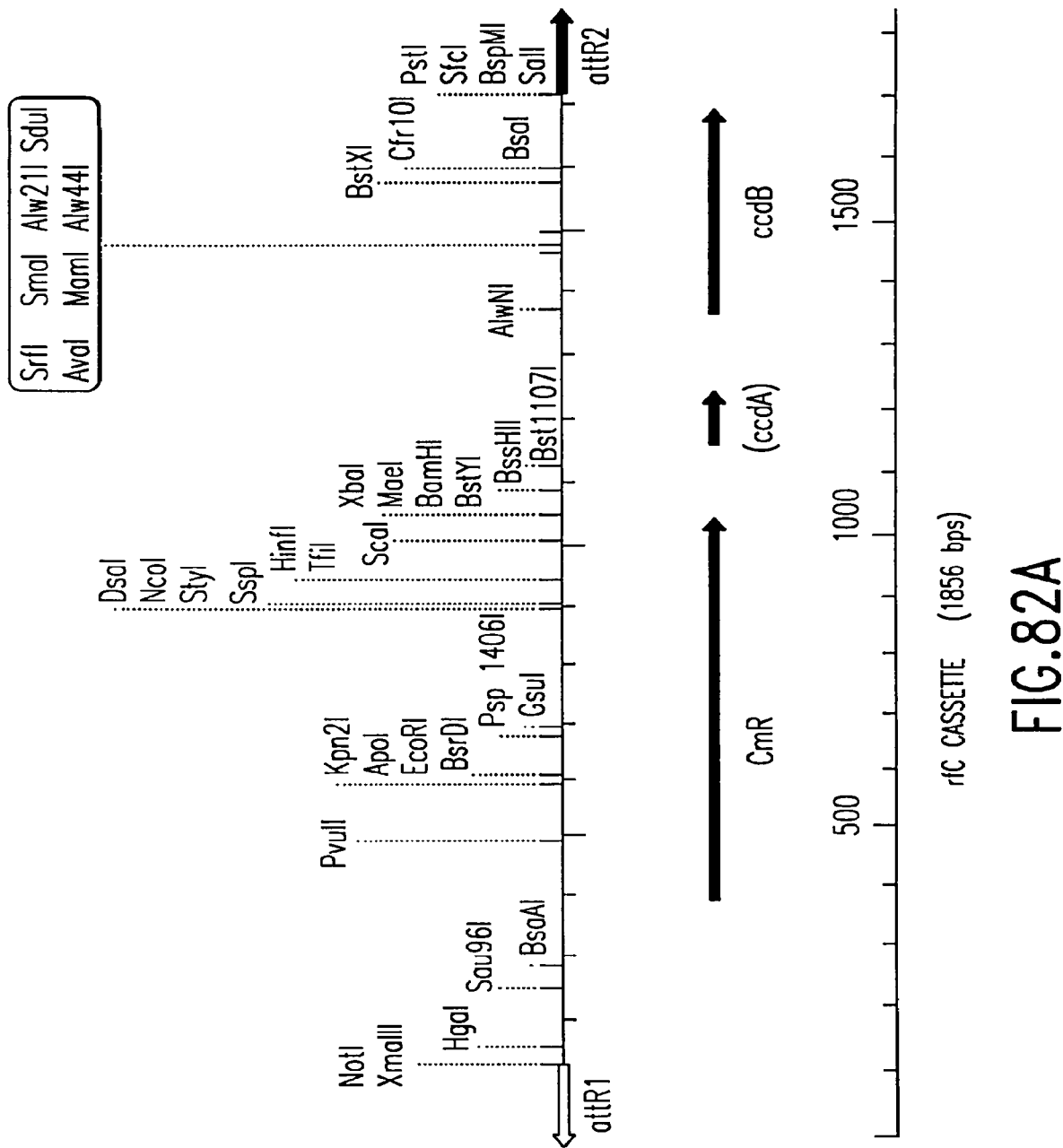
FIG. 82 illustrates the single-cutting restriction sites in two alternative attR reading frame C cassettes of the invention (FIGS. 82A and 82B) depicted in FIG. 78.
Figure 82B:
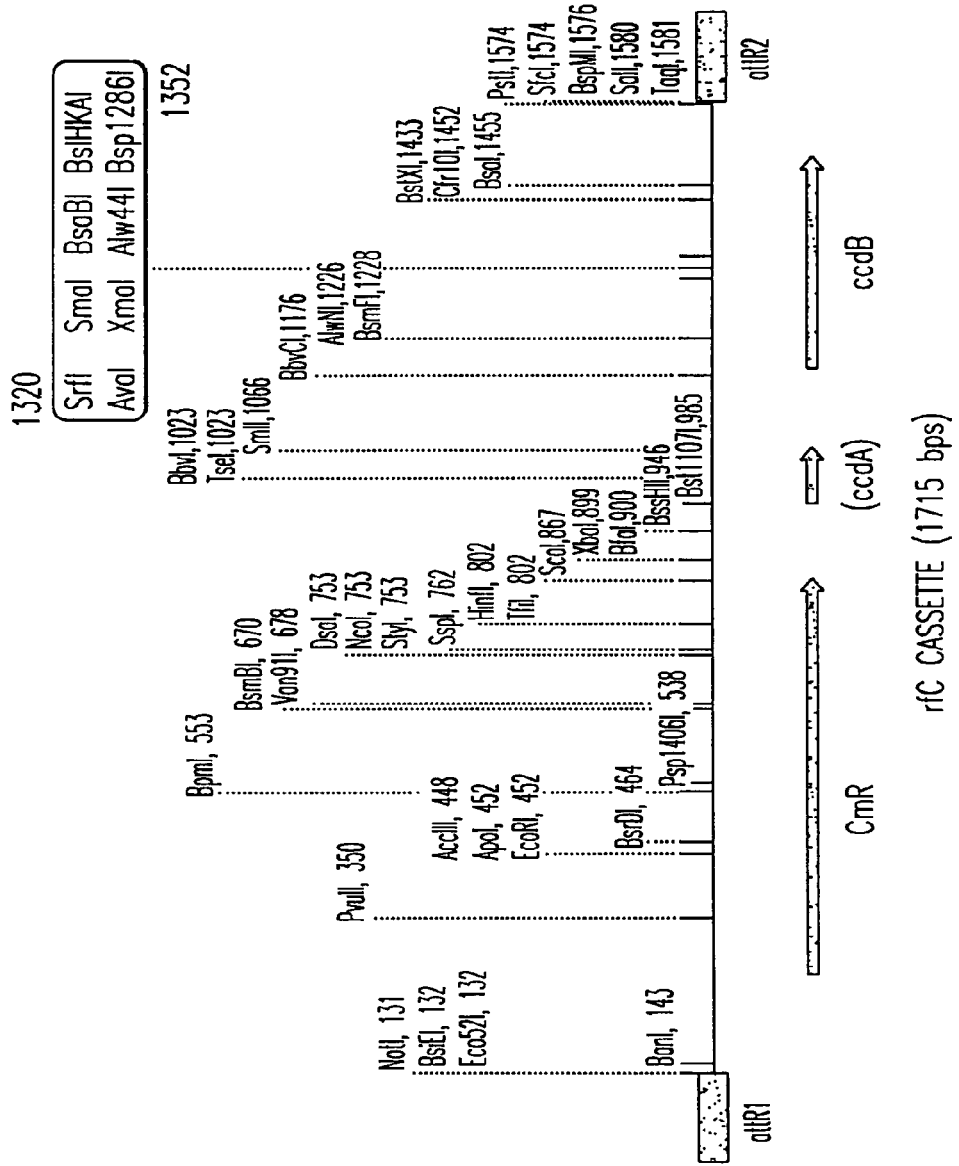
Figure 83A:
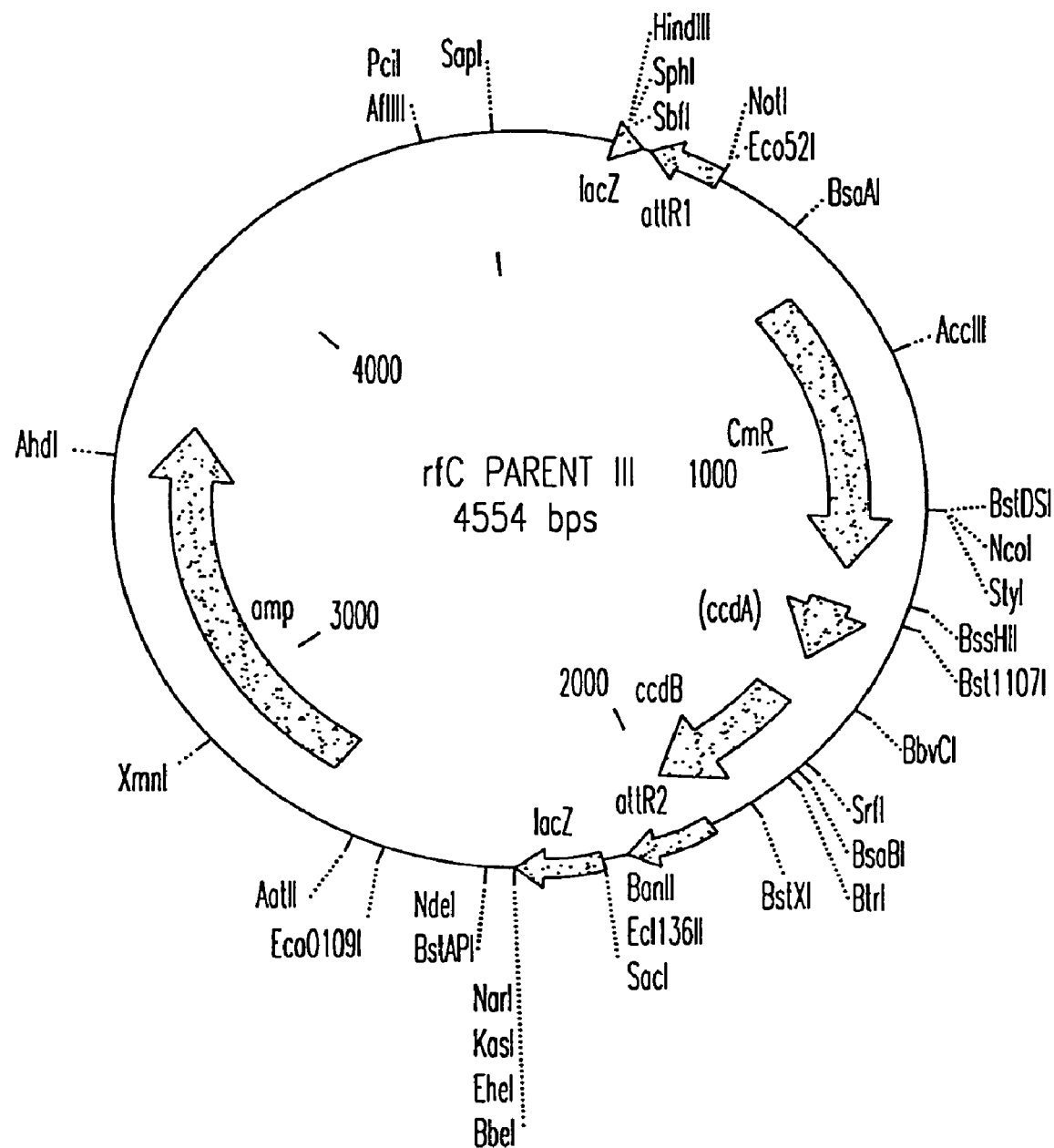
FIG. 83 shows the physical map (FIG. 83A), and the nucleotide sequence (FIGS. 83B-C) (SEQ ID NO:174), for an attR reading frame C parent plasmid prfC Parent III, which contains an attR reading frame C cassette of the invention (alternative A in FIGS. 78 and 82).

Notes on Using Destination Vectors
  We have found that about ten-fold more colonies result from a GATEWAY™ Cloning System reaction if the Destination Vector is linear or relaxed. If the competent cells you use are highly competent (>10$^8$ per microgram), linearizing the Destination Vector is less essential.
  The site or sites used for the linearization must be within the Entry Cassette. Sites that cut once or twice within each cassette are shown in FIGS. 80-82.
  Minipreps of Destination Vectors will work fine, so long as they have been treated with RNase. Since most DB strains are endA- (See U.S. Provisional Application No. 60/122,392, filed on Mar. 2, 1999, which is incorporated herein by reference), minipreps can be digested with restriction enzymes without a prior phenol extraction. Reading the OD$_{260}$ of miniprep DNA is inaccurate unless the RNA and ribonucleotides have been removed, for example, by a PEG precipitation.

Example 15

Some Options in Choosing Appropriate Entry Vectors and Destination Vectors an Example In some applications, it may be desirable to express a nucleic acid molecule of interest in two forms: as an amino-terminal fusion in *E. coli*, and as a native protein in eukaryotic cells. This may be accomplished in any of several ways:

Option 1: Your choices depend on your nucleic acid molecule of interest and the fragment that contains it, as well as the available Entry Vectors. For eukaryotic translation, you need consensus bases according to Kozak (*J. Biol. Chem.* 266:19867, 1991) near the initiating methionine (ATG) codon. All of the Entry Vectors offer this motif upstream of the XmnI site (blunt cutter). One option is to amplify your nucleic acid molecule of interest, with its ATG, by PCR, making the amino end blunt and the carboxy end containing the natural stop codon followed by one of the "right side" restriction sites (EcoRI, NotI, XhoI, EcoRV, or XbaI of the pENTR vectors).

If you know your nucleic acid molecule of interest does not have, for example, an XhoI site, you can make a PCR product that has this structure (SEQ ID NO:33):

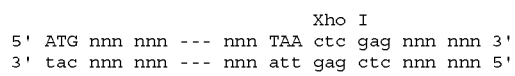
```
          Xho I
5' ATG nnn nnn --- nnn TAA ctc gag nnn nnn 3'
3' tac nnn nnn --- nnn att gag ctc nnn nnn 5'
```

After cutting with XhoI, the fragment (SEQ ID NOS 296-297, respectively, in order of appearance) is ready to clone:

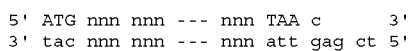
```
5' ATG nnn nnn --- nnn TAA c         3'
3' tac nnn nnn --- nnn att gag ct    5'
```

(If you follow this example, don't forget to put a phosphate on the amino oligo.)

Option 2: This PCR product could be cloned into two Entry Vectors to give the desired products, between the XmnI and XhoI sites: pENTR1A (FIGS. 10A, 10B) or pENTR7 (FIGS. 16A, 16B). If you clone into pENTR1A, amino fusions will have the minimal number of amino acids between the fusion domain and your nucleic acid molecule of interest, but the fusion cannot be removed with TEV protease. The converse is true of clones in pENTR7, i.e., an amino fusion can be cleaved with TEV protease, at the cost of more amino acids between the fusion and your nucleic acid molecule of interest.

Figure 26B:
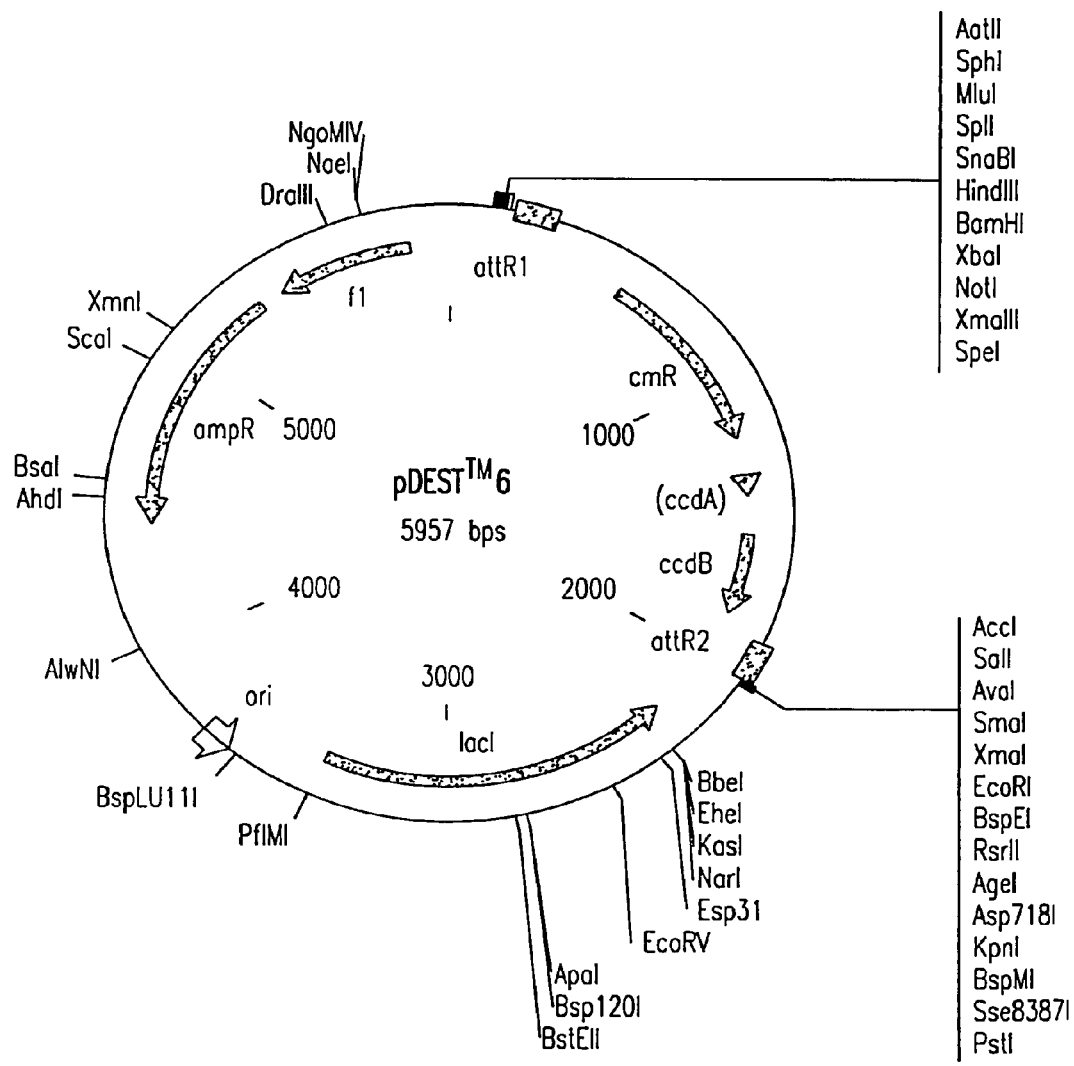
FIG. 26 is a schematic depiction of the attR1 and attR2 sites (FIG. 26A) (SEQ ID NOS 233-234, respectively, in order of appearance), the physical map (FIG. 26B), and the nucleotide sequence (FIGS. 26C-D) (SEQ ID NO:134), of Destination Vector pDEST6. This vector may also be referred to as pSPORT(−)-DEST6.
Figure 27A:
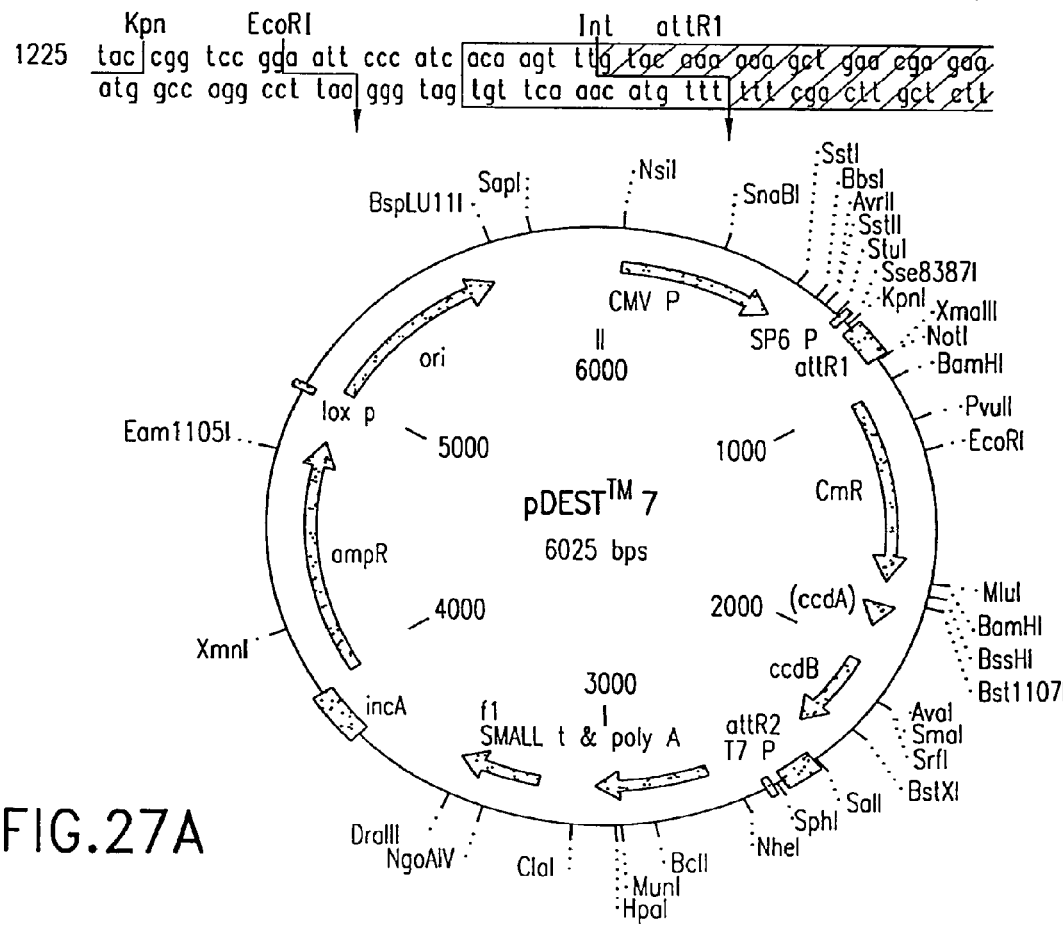
FIG. 27 is a schematic depiction of the attR1 site, CMV promoter, and the physical map (FIG. 27A) (SEQ ID NO: 235), and the nucleotide sequence (FIGS. 27B-C) (SEQ ID NO:135), of Destination Vector pDEST7. This vector may also be referred to as pCMV-DEST7.
Figure 30A:
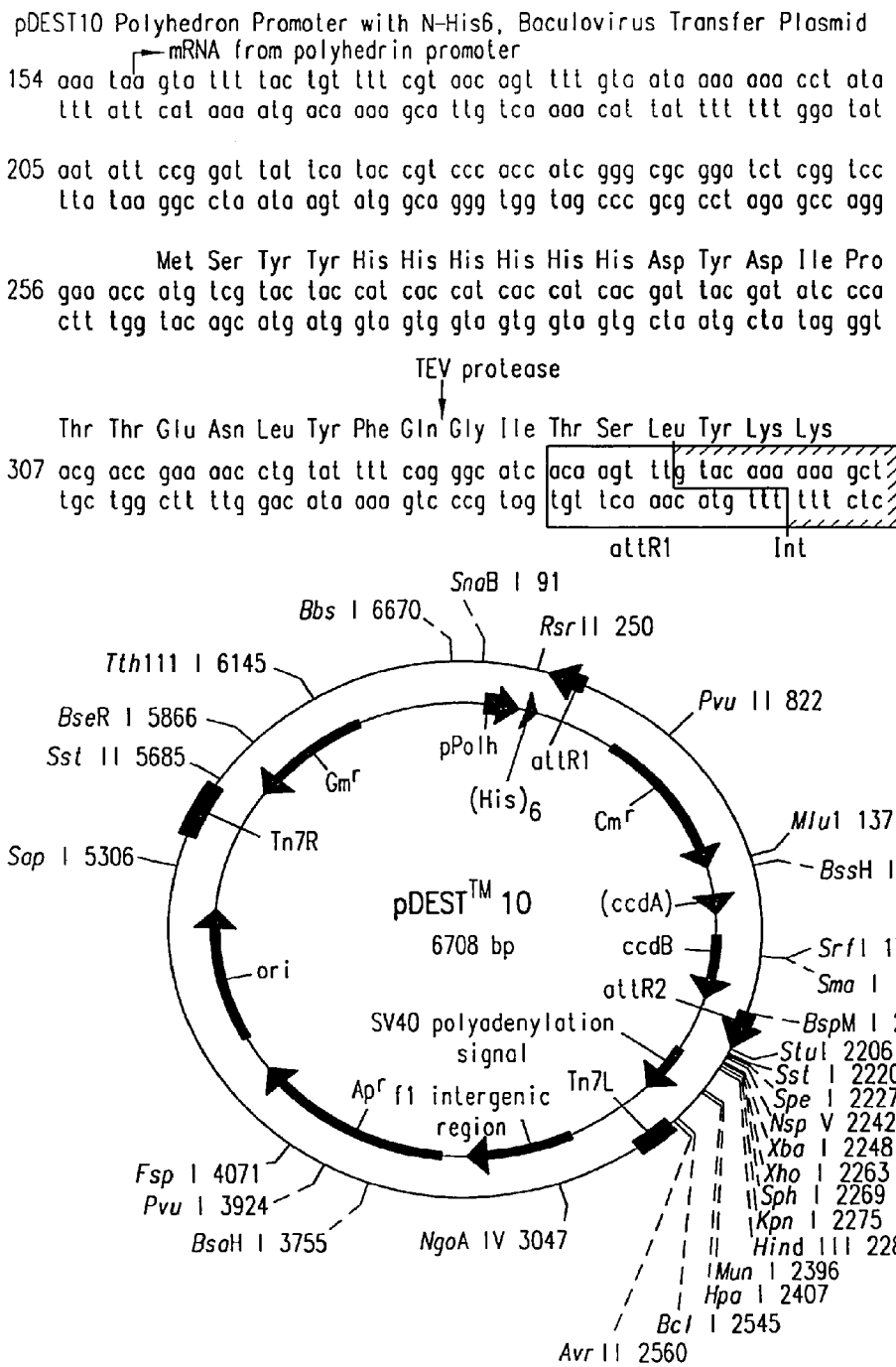
FIG. 30 is a schematic depiction of the attR1 site, baculovirus polyhedrin promoter, His6 fusion domain, and the physical map (FIG. 30A) (SEQ ID NOS 238-239, respectively, in order of appearance), and the nucleotide sequence (FIGS. 30B-D) (SEQ ID NO:138), of Destination Vector pDEST10. This vector may also be referred to as pFastBacHT-DEST10.
Figure 34A:
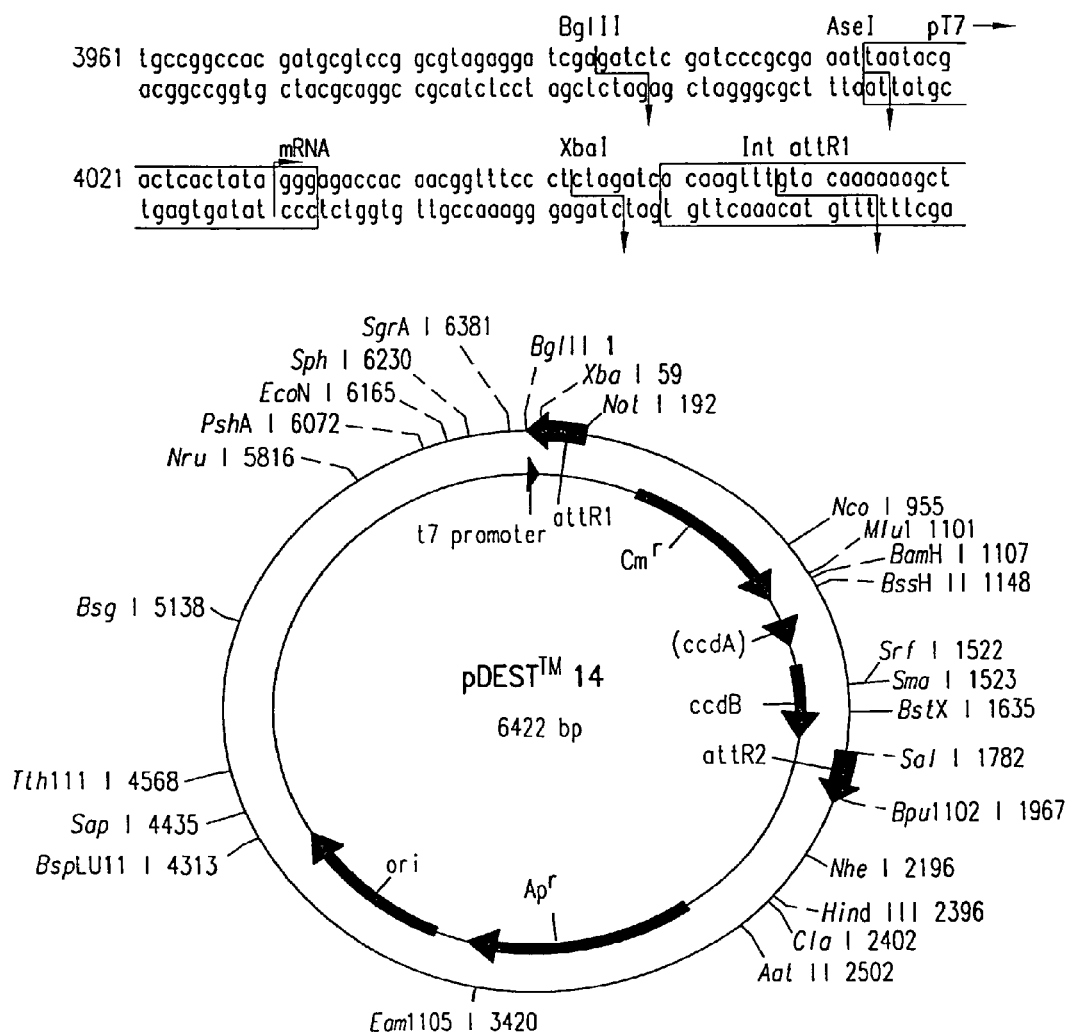
FIG. 34 is a schematic depiction of the attR1 site, the T7 promoter, and the physical map (FIG. 34A) (SEQ ID NO: 243), and the nucleotide sequence (FIGS. 34B-D) (SEQ ID NO:142), of Destination Vector pDEST14. This vector may also be referred to as pPT7-DEST14.
Figure 35A:
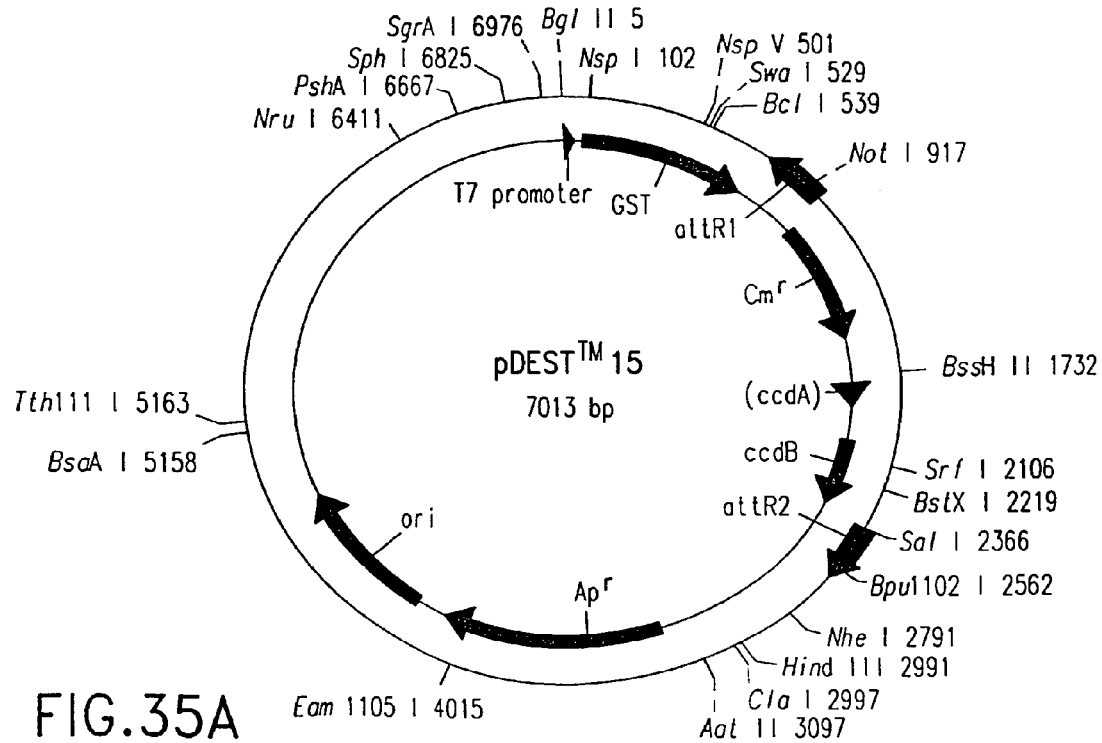
FIG. 35 is a schematic depiction of the attR1 site, the T7 promoter, and the N-terminal GST fusion sequence, and the physical map (FIG. 35A) (SEQ ID NOS 244-247, respectively, in order of appearance), and the nucleotide sequence (FIGS. 35B-D) (SEQ ID NO:143), of Destination Vector pDEST15. This vector may also be referred to as pT7 GST-DEST15.
Figure 36A:
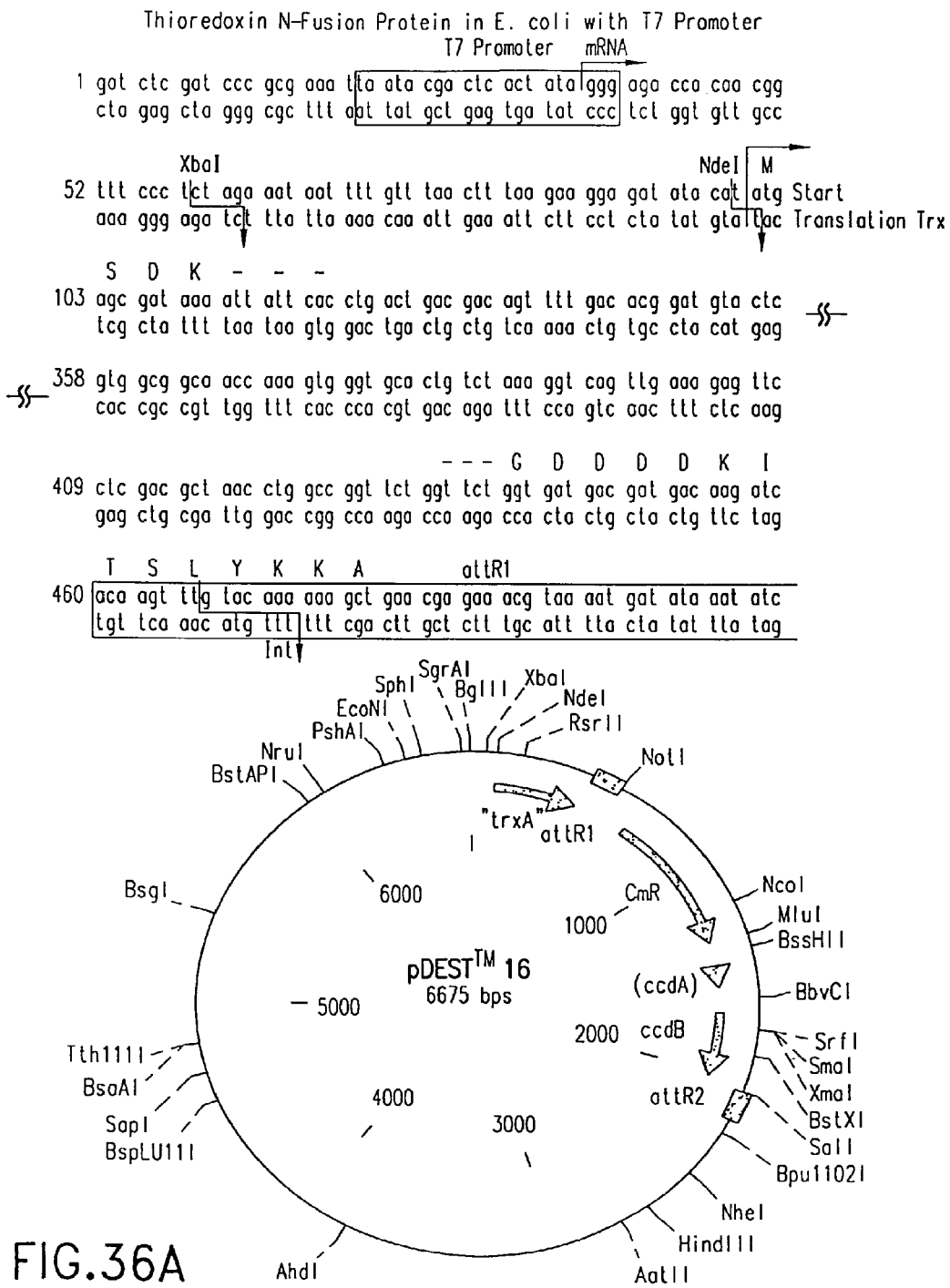
FIG. 36 is a schematic depiction of the attR1 site, the T7 promoter, and the N-terminal thioredoxin fusion sequence, and the physical map (FIG. 36A) (SEQ ID NOS 248-251, respectively, in order of appearance), and the nucleotide sequence (FIGS. 36B-D) (SEQ ID NO:144), of Destination Vector pDEST16. This vector may also be referred to as pT7 Trx-DEST16.
Figure 37A:
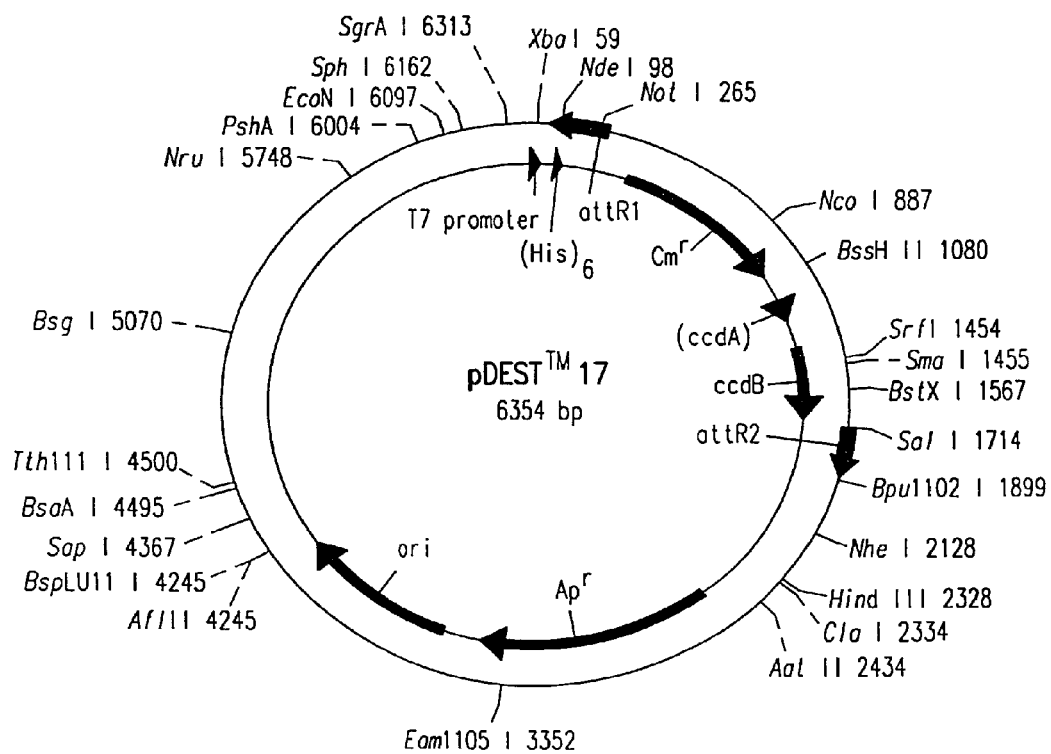
FIG. 37 is a schematic depiction of the attR1 site, the T7 promoter, and the N-terminal His6 fusion sequence, and the physical map (FIG. 37A) (SEQ ID NOS 252-253, respectively, in order of appearance), and the nucleotide sequence (FIGS. 37B-D) (SEQ ID NO:145), of Destination Vector pDEST17. This vector may also be referred to as pT7 His-DEST17.
Figure 41A:
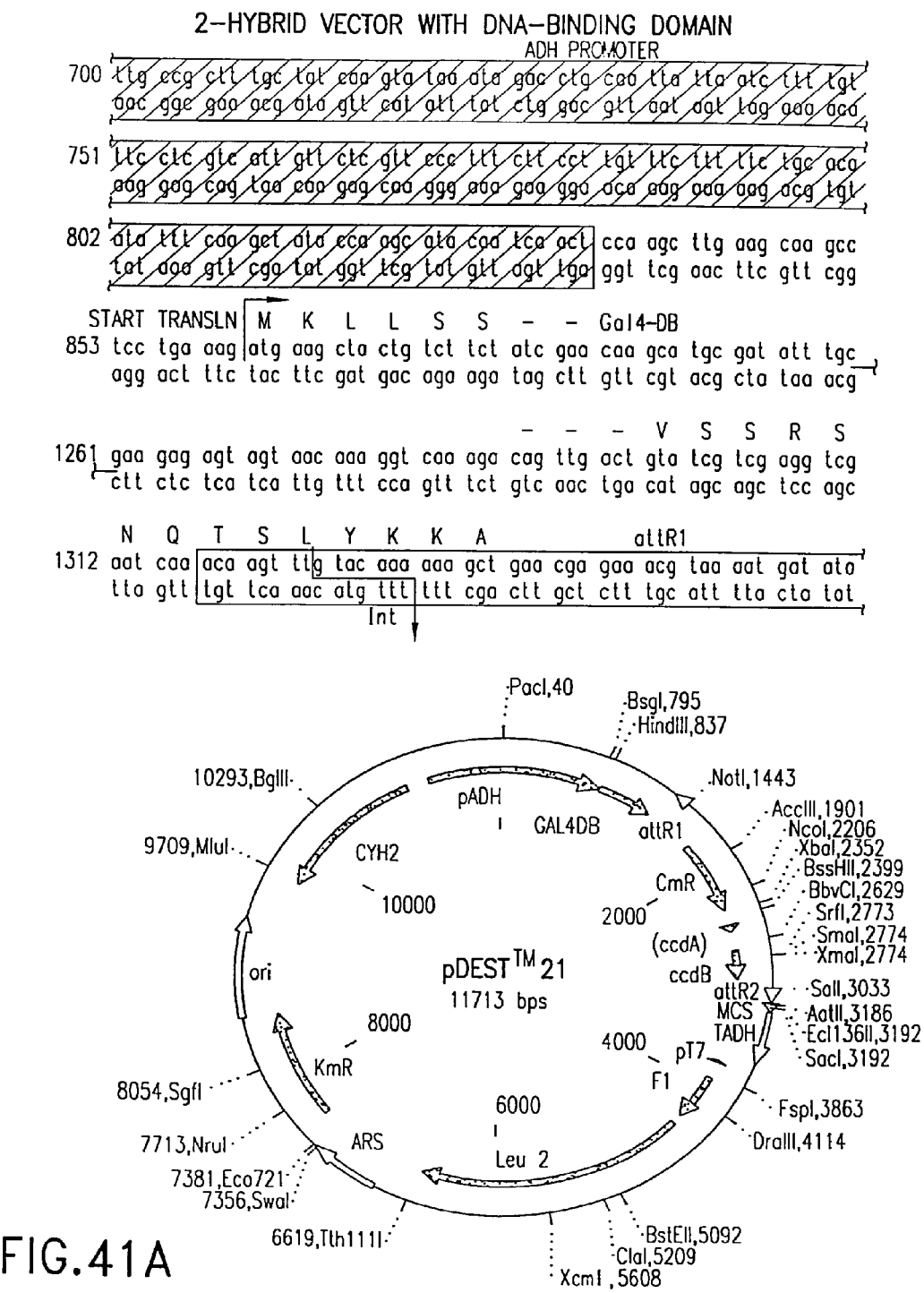
FIG. 41 is a schematic depiction of a 2-hybrid vector with a DNA-binding domain, the attR1 site, and the ADH promoter, and the physical map (FIG. 41A) (SEQ ID NOS 260-261, 263 and 262, respectively, in order of appearance), and the nucleotide sequence (FIGS. 41B-E) (SEQ ID NO:149), of Destination Vector pDEST21. This vector may also be referred to as pDB Leu-DEST21.
Figure 42A:
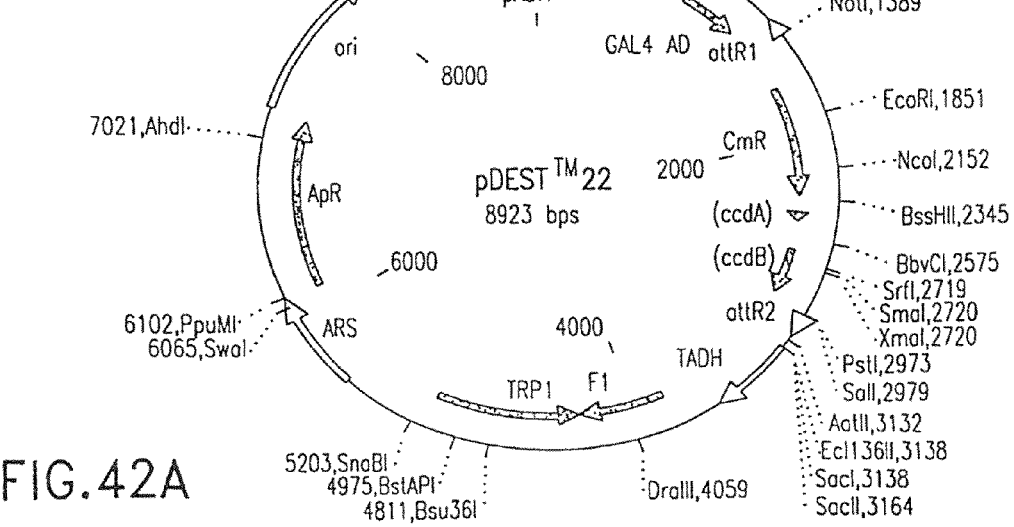
FIG. 42 is a schematic depiction of a 2-hybrid vector with an activation domain, the attR1 site, and the ADH promoter, and the physical map (FIG. 42A) (SEQ ID NOS 264-265, 267 and 266, respectively, in order of appearance), and the nucleotide sequence (FIGS. 42B-D) (SEQ ID NO:150), of Destination Vector pDEST22. This vector may also be referred to as pPC86-DEST22.
Figure 43A:
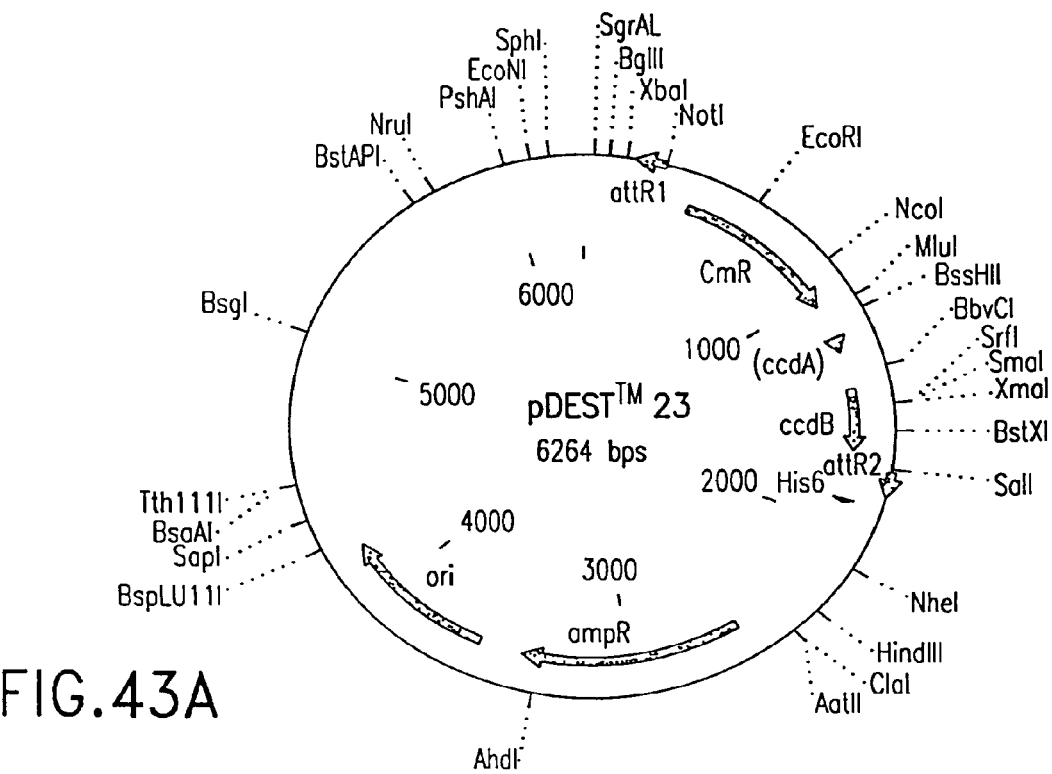
FIG. 43 is a schematic depiction of the attR1 and attR2 sites, the T7 promoter, and the C-terminal His6 fusion sequence, and the physical map (FIG. 43A) (SEQ ID NOS 268-270, respectively, in order of appearance), and the nucleotide sequence (FIGS. 43B-D) (SEQ ID NO:151), of Destination Vector pDEST23. This vector may also be referred to as pC-term-His6-DEST23.
Figure 47A:
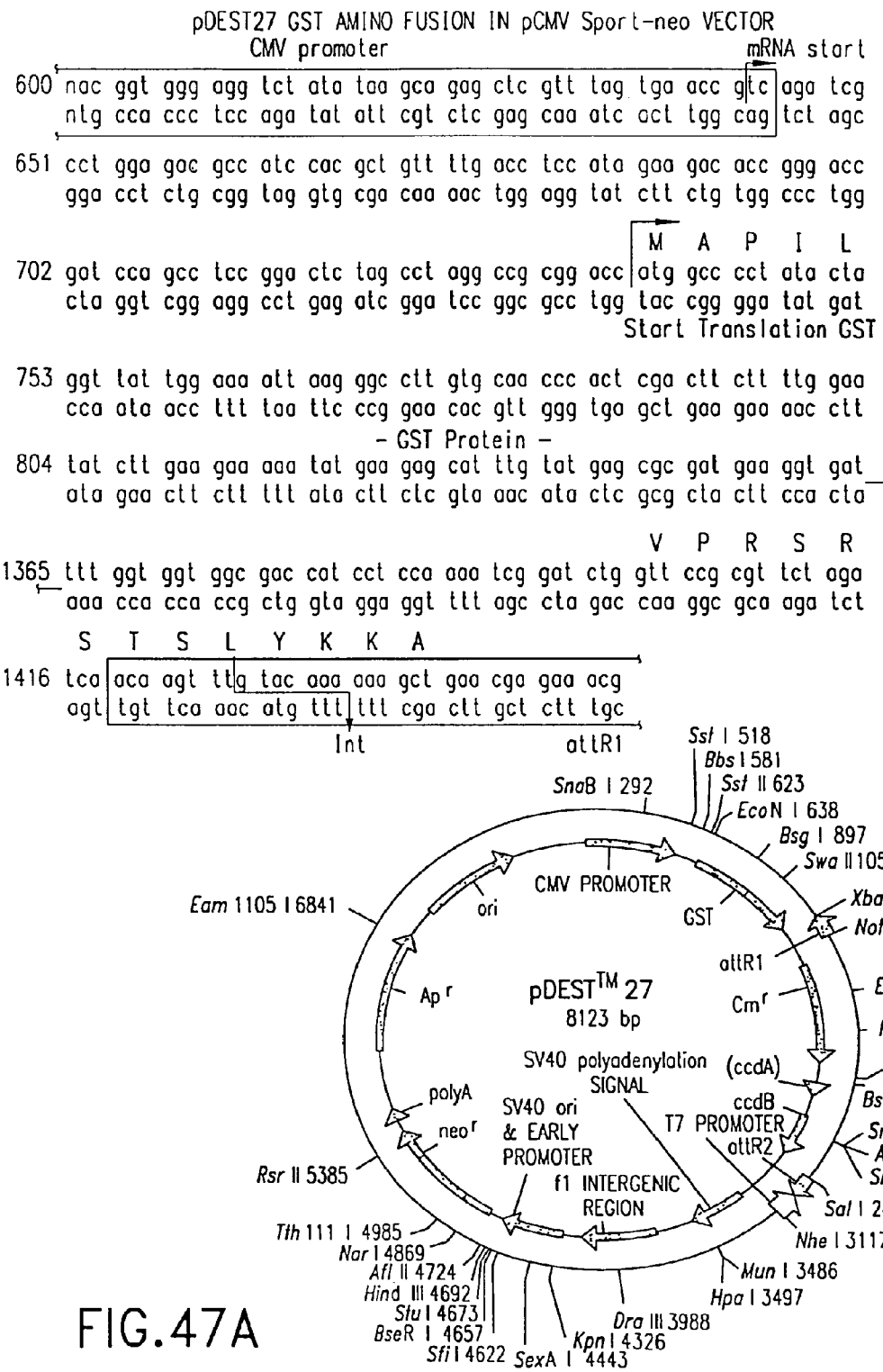
FIG. 47 is a schematic depiction of the attR1 site, the CMV promoter, and an N-terminal GST fusion sequence, and the physical map (FIG. 47A) (SEQ ID NOS 279-280, 282 and 281, respectively, in order of appearance), and the nucleotide sequence (FIGS. 47B-D) (SEQ ID NO:155), of Destination Vector pDEST27. This vector may also be referred to as pCMV-Spneo-GST-DEST27.

In this example, let us choose to clone our hypothetical nucleic acid molecule of interest into pENTR7, between the XmnI and XhoI sites. Once this is accomplished, several optional protocols using the Entry Clone pENTR7 may be followed:

Option 3: Since the nucleic acid molecule of interest has been amplified with PCR, it may be desirable to sequence it. To do this, transfer the nucleic acid molecule of interest from the Entry Vector into a vector that has priming sites for the standard sequencing primers. Such a vector is pDEST6 (FIGS. 26A, 26B). This Destination Vector places the nucleic acid molecule of interest in the opposite orientation to the lac promoter (which is leaky—see Example 3 above). If the gene product is toxic to *E. coli*, this Destination Vector will minimize its toxicity.

Option 4: While the sequencing is going on, you might wish to check the expression of the nucleic acid molecule of interest in, for example, CHO cells, by recombining the nucleic acid molecule of interest into a CMV promoter vector (pDEST7, FIG. 27; or pDEST12, FIG. 32), or into a baculovirus vector (pDEST8, FIG. 28; or pDEST10, FIG. 30) for expression in insect cells. Both of these vectors will transcribe the coding sequence of your nucleic acid molecule of interest, and translate it from the ATG of the PCR product using the Kozak bases upstream of the XmnI site.

Option 5: If you wish to purify protein, for example to make antibodies, you can clone the nucleic acid molecule of interest into a His6 fusion vector, pDEST2 (FIG. 22). Since the nucleic acid molecule of interest is cloned downstream of the TEV protease cleavage domain of pENTR7 (FIG. 16), the amino acid sequence of the protein produced will be:

```
                                                 (SEQ ID NO: 34)
            [------ attB1 -----]        TEV protease
NH2-MSYYHHHHHHGITSLYKKAGFENLYFQTM----COOH
```

The attB site and the restriction sites used to make the Destination and Entry Vectors are translated into the underlined 11 amino acids (GITSLYKKAGF) (SEQ ID NO:35). Cleavage with TEV protease (arrow) leaves two amino acids, GT, on the amino end of the gene product.

See FIG. 55 for an example of a nucleic acid molecule of interest, the chloramphenicol acetyl transferase (CAT) gene, cloned into pENTR7 (FIG. 16) as a blunt (amino)-XhoI (carboxy) fragment, then cloned by recombination into the His6 fusion vector pDEST2 (FIG. 22).

Option 6: If the His6 fusion protein is insoluble, you may go on and try a GST fusion. The appropriate Destination vector is pDEST3 (FIG. 23).

Option 7: If you need to make RNA probes and prefer SP6 RNA polymerase, you can make the top strand RNA with your nucleic acid molecule of interest cloned into pSPORT+ (pDEST5 (FIGS. 25A, 25B)), and the bottom strand RNA with the nucleic acid molecule of interest cloned into pSPORT(−) (pDEST6 (FIGS. 26A, 26B)). Opposing promoters for T7 RNA polymerase and SP6 RNA polymerase are also present in these clones.

Option 8: It is often worthwhile to clone your nucleic acid molecule of interest into a variety of Destination Vectors in the same experiment. For example, if the number of colonies varies widely when the various recombination reactions are transformed into *E. coli*, this may be an indication that the nucleic acid molecule of interest is toxic in some contexts. (This problem is more clearly evident when a positive control gene is used for each Destination Vector.) Specifically, if many more colonies are obtained when the nucleic acid molecule of interest is recombined into pDEST6 than in pDEST5, there is a good chance that leakiness of the lac promoter is causing some expression of the nucleic acid molecule of interest in pSPORT "+" (which is not harmful in pDEST6 because the nucleic acid molecule of interest is in the opposite orientation).

Example 16

Demonstration of a One-Tube Transfer of a PCR Product (or Expression Clone) to Expression Clone Via a Recombinational Cloning Reaction In the B×P recombination (Entry or Gateward) reaction described herein, a DNA segment flanked by attB1 and attB2 sites in a plasmid conferring ampicillin resistance was transferred by recombination into an attP plasmid conferring kanamycin resistance, which resulted in a product molecule wherein the DNA segment was flanked by attL sites (attL1 and attL2). This product plasmid comprises an "attL Entry Clone" molecule, because it can react with a "attR Destination Vector" molecule via the L×R (Destination) reaction, resulting in the transfer of the DNA segment to a new (ampicillin resistant) vector. In the previously described examples, it was necessary to transform the B×P reaction products into *E. coli*, select kanamycin resistant colonies, grow those colonies in liquid culture, and prepare miniprep DNA, before reacting this DNA with a Destination Vector in an L×R reaction.

The goal of the following experiment was to eliminate the transformation and miniprep DNA steps, by adding the B×P Reaction products directly to an L×R Reaction. This is especially appropriate when the DNA segment flanked by attB sites is a PCR product instead of a plasmid, because the PCR product cannot give ampicillin-resistant colonies upon transformation, whereas attB plasmids (in general) carry an ampicillin resistance gene. Thus use of a PCR product flanked by attB sites in a B×P Reaction allows one to select for the ampicillin resistance encoded by the desired attB product of a subsequent L×R Reaction.

Two reactions were prepared: Reaction A, negative control, no attB PCR product, (8 µl) contained 50 ng pEZC7102 (attP Donor plasmid, confers kanamycin resistance) and 2 µl B×P Clonase (22 ng/µl Int protein and 8 ng/µl IHF protein) in B×P buffer (25 mM Tris HCl, pH 7.8, 70 mM KCl, 5 mM spermidine, 0.5 mM EDTA, 250 µg/ml BSA). Reaction B (24 µl) contained 150 ng pEZC7102, 6 µl B×P Clonase, and 120 ng of the attB-tet-PCR product in the same buffer as reaction A. The attB-tet-PCR product comprised the tetracycline resistance gene of plasmid pBR322, amplified with two primers containing either attB1 or attB2 sites, and having 4 Gs at their 5' ends, as described earlier.

The two reactions were incubated at 25° C. for 30 minutes. Then aliquots of these reactions were added to new components that comprised L×R Reactions or appropriate controls for the L×R Reaction. Five new reactions were thus produced:

Reaction 1: 5 µl of reaction A was added to a 5 µl L×R Reaction containing 25 ng NcoI-cut pEZC8402 (the attR Destination Vector plasmid) in L×R buffer (37.5 mM Tris HCl, pH 7.7, 16.5 mM NaCl, 35 mM KCl, 5 mM spermidine, 375 µg/ml BSA), and 1 µl of GATEWAY™ LR Clonase™ Enzyme Mix (total volume of 10 µl).

Reaction 2: Same as reaction 1, except 5 µl of reaction B (positive) were added instead of reaction A (negative).

Reaction 3: Same as reaction 2, except that the amounts of Nco-cut pEZC8402 and GATEWAY™ LR Clonase™ Enzyme Mix were doubled, to 50 ng and 2 µl, respectively.

Reaction 4: Same as reaction 2, except that 25 ng of pEZ1104 (a positive control attL Entry Clone plasmid) were added in addition to the aliquot of reaction B.

Reaction 5: Positive control L×R Reaction, containing 25 ng NcoI-cut pEZC8402, 25 ng pEZ11104, 37.5 mM Tris HCl pH 7.7, 16.5 mM NaCl, 35 mM KCl, 5 mM spermidine, 375 µg/ml BSA and 1 µl GATEWAY™ LR Clonase™ Enzyme Mix in a total volume of 5 µl.

All five reactions were incubated at 25° C. for 30 minutes. Then, 1 µl aliquots of each of the above five reactions, plus 1 µl from the remaining volume of Reaction B, the standard B×P Reaction, were used to transform 50 µl competent DH5α *E. coli*. DNA and cells were incubated on ice for 15 min., heat shocked at 42° C. for 45 sec., and 450 µl SOC were added. Each tube was incubated with shaking at 37° C. for 60 min. Aliquots of 100 µl and 400 µl of each transformation were plated on LB plates containing either 50 μg/ml kanamycin or 100 μg/ml ampicillin (see Table 2). A transformation with 10 pg of pUC19 DNA (plated on LB-amp$_{100}$) served as a control on the transformation efficiency of the DH5α cells. Following incubation overnight at 37° C., the number of colonies on each plate was determined.

Results of these reactions are shown in Table 2.

TABLE 2*

| | Reaction No.: | | | | | |
|---|---|---|---|---|---|---|
| | 1 | 2 | 3 | 4 | 5 | 6 |
| | | | Number of Colonies | | | |
| Vol. plated: | Neg. Control BxP Reaction | 1X pEZC8402 and LR Clonase ™ | 2X pEZC8402 and LR Clonase ™ | LxR Reaction with Pos. Control DNA | LxR Reaction alone | BxP Reaction alone |
| 100 μl | 2 | 1 | 8 | 9 | ~1000 | ~1000 |
| 400 μl | 5 | 10 | 35 | 62 | >2000 | >2000 |
| Selection: | Kan | Amp | Amp | Amp | Amp | Kan |

*(Transformation with pUC 19 DNA yielded 1.4 × 10$^9$ CFU/μg DNA.)

34 of the 43 colonies obtained from Reaction 3 were picked into 2 ml Terrific Broth with 100 μg/ml ampicillin and these cultures were grown overnight, with shaking, at 37° C. 27 of the 34 cultures gave at least moderate growth, and of these 24 were used to prepare miniprep DNA, using the standard protocol. These 24 DNAs were initially analyzed as supercoiled (SC) DNA on a 1% agarose gel to identify those with inserts and to estimate the sizes of the inserts. Fifteen of the 24 samples displayed SC DNA of the size predicted (5553 bp) if tetx7102 had correctly recombined with pEZC8402 to yield tetx8402. One of these samples contained two plasmids, one of ~5500 bp and a one of ~3500 bp. The majority of the remaining clones were approximately 4100 bp in size.

Figure 57:
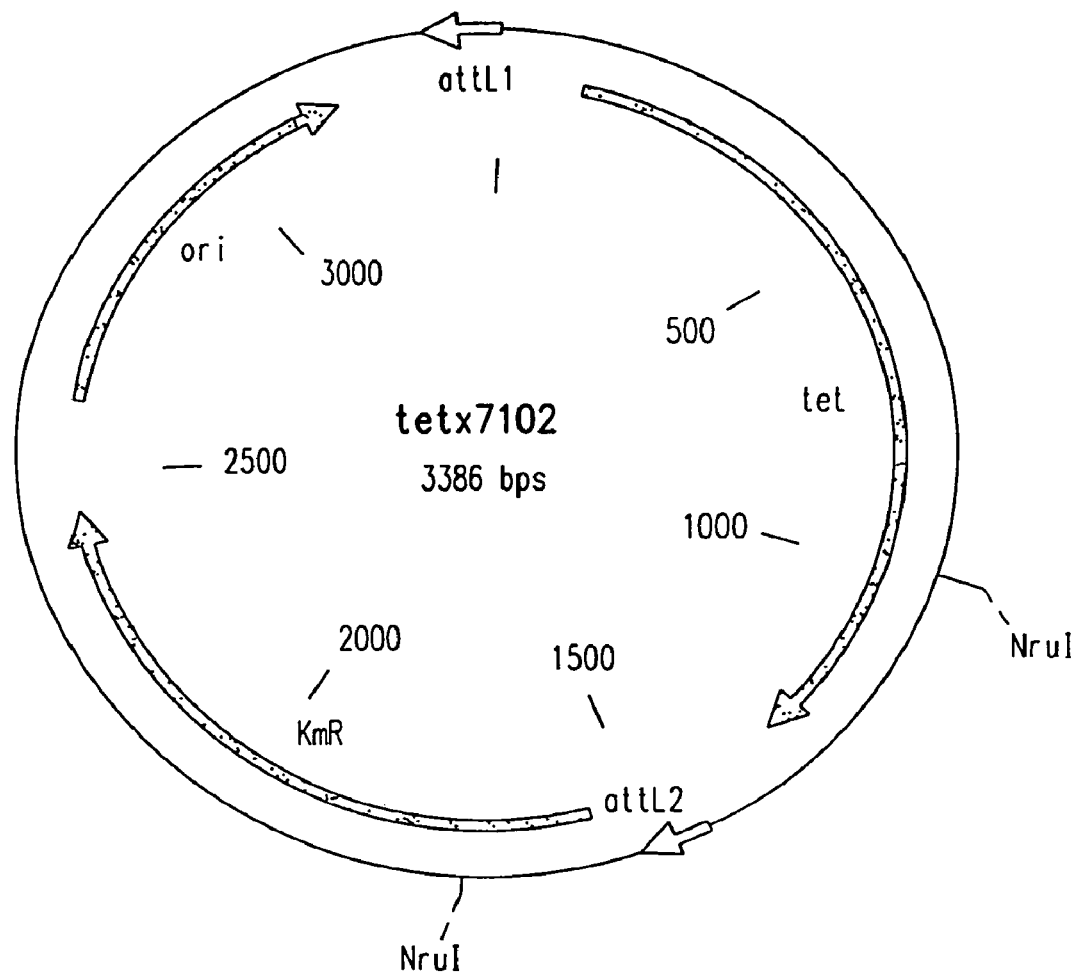
FIG. 57 is a physical map of the desired product of Reaction B of the one-tube B×P reaction described in Example 16, tetx7102.
Figure 58:
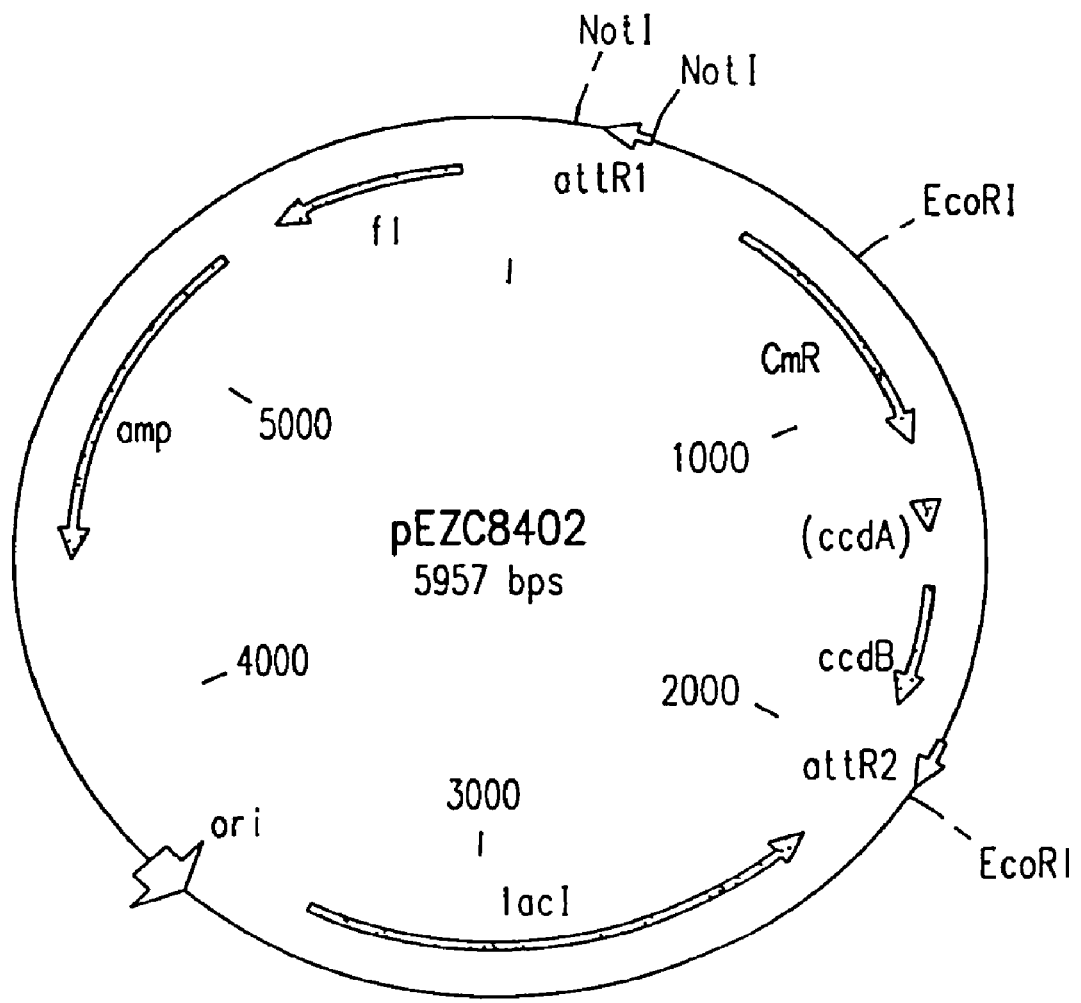
FIG. 58 is a physical map of the Destination Vector pEZC8402.

All 15 of the clones displaying SC DNA of predicted size (~5500 bp) were analyzed by two different double digests with restriction endonucleases to confirm the structure of the expected product: tetx8402. (See plasmid maps, FIGS. 57-59) In one set of digests, the DNAs were treated with Not I and Eco RI, which should cut the predicted product just outside both attB sites, releasing the tetr insert on a fragment of 1475 bp. In the second set of digests, the DNAs were digested with NotI and with NruI. NruI cleaves asymmetrically within the subcloned tet$^r$ insert, and together with NotI will release a fragment of 1019 bp.

Of the 15 clones analyzed by double restriction digestion, 14 revealed the predicted sizes of fragments for the expected product.

Figure 56:
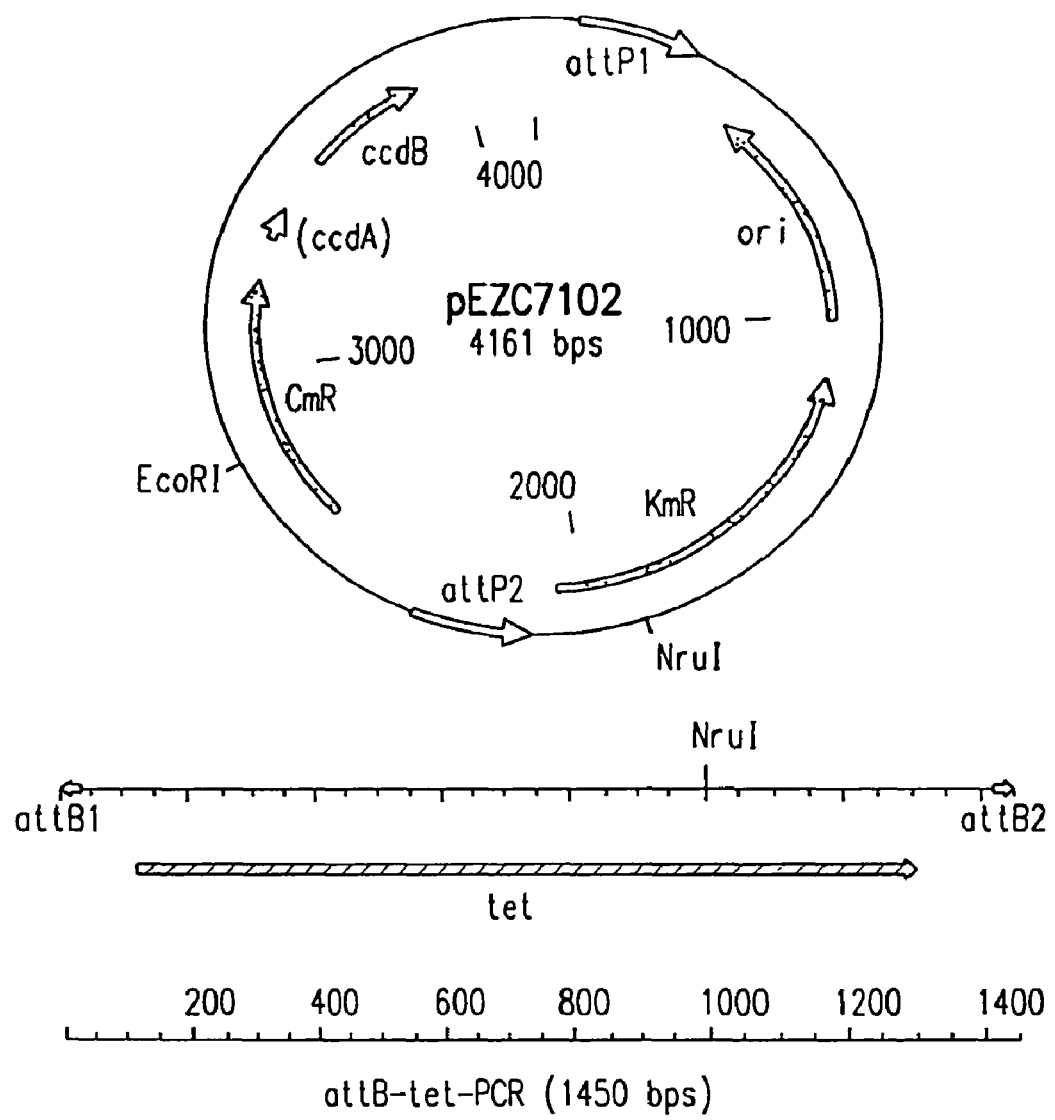
FIG. 56 depicts the DNA components of Reaction B of the one-tube B×P reaction described in Example 16, pEZC7102 and attB-tet-PCR.

Interpretation:

The DNA components of Reaction B, pEZC7102 and attB-tet-PCR, are shown in FIG. 56. The desired product of BxP Reaction B is tetx7102, depicted in FIG. 57. The LxR Reaction recombines the product of the BxP Reaction, tetx7102 (FIG. 57), with the Destination Vector, pEZC8402, shown in FIG. 58. The LxR Reaction with tetx7102 plus pEZC8402 is predicted to yield the desired product tetx8402, shown in FIG. 59.

Reaction 2, which combined the BxP Reaction and LxR Reaction, gave few colonies beyond those of the negative control Reaction. In contrast, Reaction 3, with twice the amount of pEZC8402 (FIG. 58) and LxR Clonase, yielded a larger number of colonies. These colonies were analyzed further, by restriction digestion, to confirm the presence of expected product. Reaction 4 included a known amount of attL Entry Clone plasmid in the combined BxP-plus-LxR reaction. But reaction 4 yielded only about 1% of the colonies obtained when the same DNA was used in a LxR reaction alone, Reaction 6. This result suggests that the LxR reaction may be inhibited by components of the BxP reaction.

Figure 59:
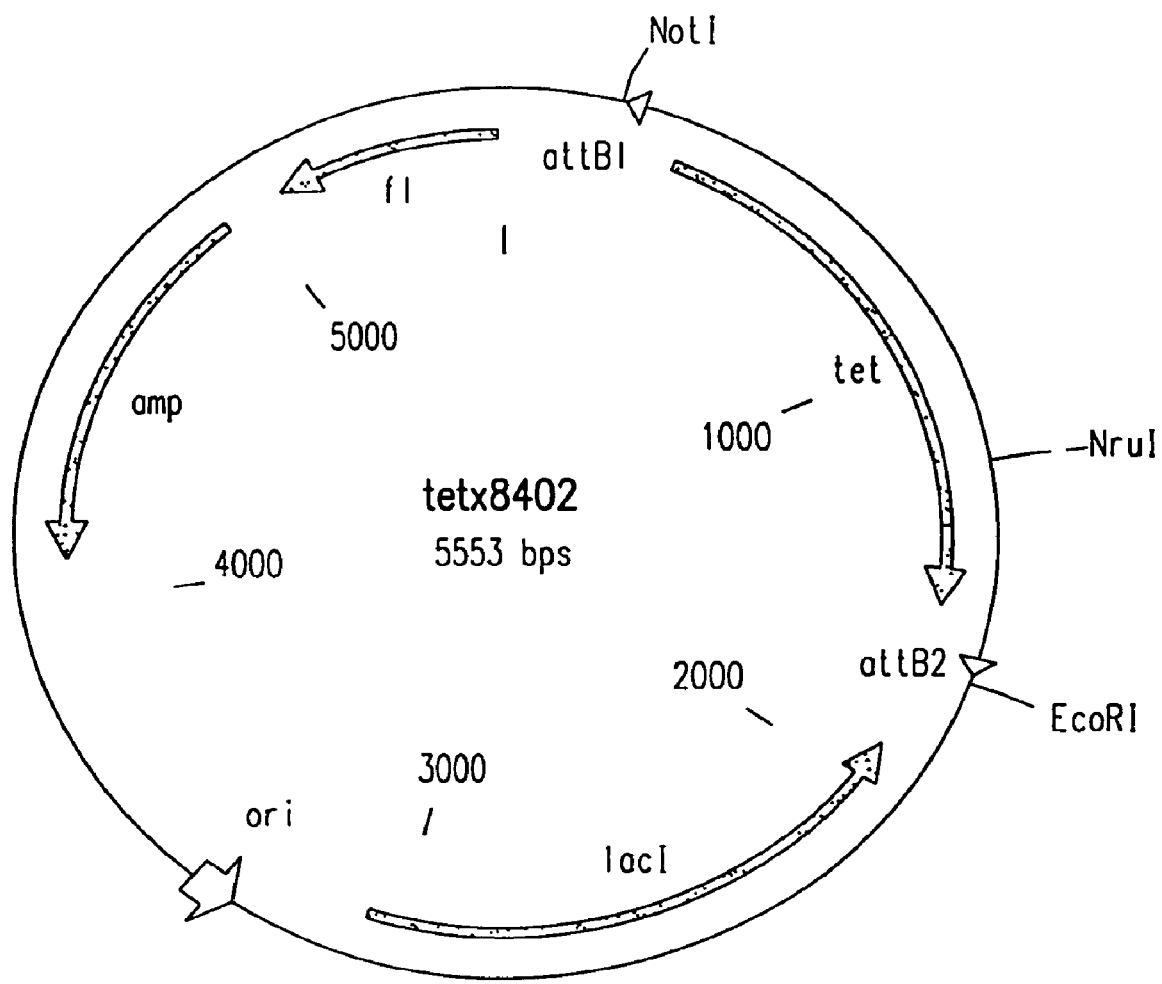
FIG. 59 is a physical map of the expected tetr subclone product, tetx8402, resulting from the L×R Reaction with tetx7102 (FIG. 57) plus pEZC8402 (FIG. 58).

Restriction endonuclease analysis of the products of Reaction 3 revealed that a sizeable proportion of the colonies (14 of the 34 analyzed) contained the desired tet$^r$ subclone, tetx8402 (FIG. 59).

The above results establish the feasibility of performing first a BxP recombination reaction followed by a LxR recombination reaction—in the same tube—simply by adding the appropriate buffer mix, recombination proteins, and DNAs to a completed BxP reaction. This method should prove useful as a faster method to convert attB-containing PCR products into different Expression Clones, eliminating the need to isolate first the intermediate attL-PCR insert subclones, before recombining these with Destination Vectors. This may prove especially valuable for automated applications of these reactions.

This same one-tube approach allows for the rapid transfer of nucleic acid molecules contained in attB plasmid clones into new functional vectors as well. As in the above examples, attL subclones generated in a BxP Reaction can be recombined directly with various Destination Vectors in a LxR reaction. The only additional requirement for using attB plasmids, instead of attB-containing PCR products, is that the Destination Vector(s) employed must contain a different selection marker from the one present on the attB plasmid itself and the attP vector.

Two alternative protocols for a one-tube reaction have also proven useful and somewhat more optimal than the conditions described above.

Alternative 1

Reaction buffer contained 50 mM Tris-HCl (pH 7.5), 50 mM NaCl, 0.25 mM EDTA, 2.5-mM spermidine, and 200 μg/ml BSA. After a 16 (or 3) hour incubation of the PCR product (100 ng)+attP Donor plasmid (100 ng)+GATEWAY™ BP Clonase™ Enzyme Mix+Destination Vector (100 ng), 2 μl of GATEWAY™ LR Clonase™ Enzyme Mix (per 10 μl reaction mix) was added and the mixture was incubated an additional 6 (or 2) hours at 25° C. Stop solution was then added as above and the mixture was incubated at 37° C. as above and transformed by electroporation with 1 μl directly into electrocompetent host cells. Results of this series of experiments demonstrated that longer incubation times (16 hours vs. 3 hours for the BP Reaction, 6 hours vs. 2 hours for the LR Reaction) resulted in about twice as many colonies being obtained as for the shorter incubation times. With two independent genes, 10/10 colonies having the correct cloning patterns were obtained.

Alternative 2

A standard BP Reaction under the reaction conditions described above for Alternative 1 was performed for 2 hours at 25° C. Following the BP Reaction, the following components were added to the reaction mixture in a total volume of 7 µl:

20 mM Tris-HCl, pH 7.5
100 mM NaCl
5 µg/ml Xis-His6
15% glycerol
~1000 ng of Destination Vector The reaction mixture was then incubated for 2 hours at 25° C., and 2.5 µl of stop solution (containing 2 µg/ml proteinase K) was added and the mixture was incubated at 37° C. for an additional 10 minutes. Chemically competent host cells were then transformed with 2 µl of the reaction mixture, or electrocompetent host cells (e.g., EMax DH10B cells; Life Technologies, Inc.) were electroporated with 2 µl of the reaction mixture per 25-40 µl of cells. Following transformation, mixtures were diluted with SOC, incubated at 37° C., and plated as described above on media selecting for the selection markers on the Destination Vector and the Entry clone (B x P reaction product). Analogous results to those described for Alternative 1 were obtained with these reaction conditions—a higher level of colonies containing correctly recombined reaction products were observed.

Example 17

Demonstration of a One-Tube Transfer of a PCR Product (or Expression Clone) to Expression Clone Via a Recombinational Cloning Reaction Single-tube transfer of PCR product DNA or Expression Clones into Expression Clones by recombinational cloning has also been accomplished using a procedure modified from that described in Example 16. This procedure is as follows:

Perform a standard BP (Gateward) Reaction (see Examples 9 and 10) in 20 µl volume at 25° C. for 1 hour.

After the incubation is over, take a 10 µl aliquot from the 20 µl total volume and add 1 µl of Proteinase K (2 mg/ml) and incubate at 37° C. for 10 minutes. This first aliquot can be used for transformation and gel assay of BP reaction analysis. Plate BP reaction transformation on LB plates with Kanamycin (50 ug/ml).

Add the following reagents to the remaining 10 µl aliquot of the BP reaction:
1 µl of 0.75 M NaCl
2 µl of destination vector (150 ng/µl)
4 µl of LR Clonase™ (after thawing and brief mixing)

Mix all reagents well and incubate at 25° C. for 3 hours. Stop the reaction at the end of incubation with 1.7 µl of Proteinase K (2 mg/ml) and incubate at 37° C. for 10 minutes.

Transform 2 µl of the completed reaction into 100 µl of competent cells. Plate 100 µl and 400 µl on LB plates with Ampicilin (100 µg/ml).

Notes:

If your competent cells are less than $10^8$ CFU/µg, and you are concerned about getting enough colonies, you can improve the yield several fold by incubating the BP reaction for 6-20 hours. Electroporation also can yield better colony output than chemical transformation.

PCR products greater than about 5-6 kb show significantly lower cloning efficiency in the BP reaction. In this case, we recommend using longer incubation times for both BP and LR steps.

If you want to move your insert gene into several destination vectors simultaneously, then scale up the initial BP reaction volume so that you have a 10 µl aliquot for adding each destination vector.

Example 18

Optimization of GATEWAY™ Clonase™ Enzyme Compositions

The enzyme compositions containing Int and IHF (for BP Reactions) were optimized using a standard functional recombinational cloning reaction (a BP reaction) between attB-containing plasmids and attP-containing plasmids, according to the following protocol:

Materials and Methods:
Substrates:
AttP—supercoiled pDONR201
AttB—linear ~1 Kb [$^3$H]PCR product amplified from pEZC7501
Proteins:
IntH6—His$_6$-carboxy-tagged λ Integrase
IHF—Integration Host Factor
Clonase:
50 ng/µl IntH6 and 20 ng/µl IHF, admixed in 25 mM Tris-HCl (pH 7.5),
22 mM NaCl, 5 mM EDTA, 1 mg/ml BSA, 5 mM Spermidine, and 50% glycerol.
Reaction Mixture (total volume of 40 µl):
1000 ng AttP plasmid
600 ng AttB [$^3$H] PCR product
8 µl Clonase (400 ng IntH6, 160 ng IHF) in 25 mM Tris-HCl (pH 7.5),
22 mM NaCl, 5 mM EDTA, 1 mg/ml BSA, 5 mM Spermidine, 5 mM DTT.

Reaction mixture was incubated for 1 hour at 25° C., 4 µl of 2 µg/µl proteinase K was added and mixture was incubated for an additional 20 minutes at 37° C. Mixture was then extracted with an equal volume of Phenol/Chloroform/Isoamyl alcohol. The aqueous layer was then collected, and 0.1 volumes of 3 M sodium acetate and 2 volumes of cold 100% ethanol were added. Tubes were then spun in a microcentrifuge at maximum RPM for 10 minutes at room temperature. Ethanol was decanted, and pellets were rinsed with 70% ethanol and re-centrifuged as above. Ethanol was decanted, and pellets were allowed to air dry for 5-10 minutes and then dissolved in 20 µl of 33 mM Tris-Acetate (pH 7.8), 66 mM potassium acetate, 10 mM magnesium acetate, 1 mM DTT, and 1 mM ATP. 2 units of exonuclease V (e.g., Plasmid Safe; EpiCentre, Inc., Madison, Wis.) was then added, and the mixture was incubated at 37° C. for 30 minutes.

Samples were then TCA-washed by spotting 30 µl of reaction mixture onto a Whatman GF/C filter, washing filters once with 10% TCA+1% NaPPi for 10 minutes, three times with 5% TCA for 5 minutes each, and twice with ethanol for 5 minutes each. Filters were then dried under a heat lamp, placed into a scintillation vial, and counted on a β liquid scintillation counter (LSC).

The principle behind this assay is that, after exonuclease V digestion, only double-stranded circular DNA survives in an acid-insoluble form. All DNA substrates and products that have free ends are digested to an acid-soluble form and are not retained on the filters. Therefore, only the $^3$H-labeled attB linear DNA which ends up in circular form after both inter- and intramolecular integration is complete is resistant to digestion and is recovered as acid-insoluble product. Optimal enzyme and buffer formulations in the Clonase compositions therefore are those that give the highest levels of circularized $^3$H-labeled attB-containing sequences, as determined by highest cpm in the LSC. Although this assay was designed for optimization of GATEWAY™ BP Clonase™ Enzyme Mix compositions (Int+IHF), the same type of assay may be performed to optimize GATEWAY™ LR Clonase™ Enzyme Mix compositions (Int+IHF+Xis), except that the reaction mixtures would comprise 1000 ng of AttR (instead of AttP) and 600 ng of AttL (instead of AttB), and 40 ng of His$_6$-carboxy-tagged Xis (Xis H6) in addition to the IntH6 and IHF.

Example 19

Testing Functionality of Entry and Destination Vectors

As part of assessment of the functionality of particular vectors of the invention, it is important to functionally test the ability of the vectors to recombine. This assessment can be carried out by performing a recombinational cloning reaction (as schematized in FIGS. 2, 4, and 5A and 5B, and as described herein and in commonly owned U.S. application Ser. Nos. 08/486,139, filed Jun. 7, 1995, 08/663,002, filed Jun. 7, 1996 (now U.S. Pat. No. 5,888,732), 09/005,476, filed Jan. 12, 1998, and 09/177,387, filed Oct. 23, 1998, the disclosures of all of which are incorporated by reference herein in their entireties), by transforming *E. coli* and scoring colony forming units. However, an alternative assay may also be performed to allow faster, more simple assessment of the functionality of a given Entry or Destination Vector by agarose gel electrophoresis. The following is a description of such an in vitro assay.

Figure 84:
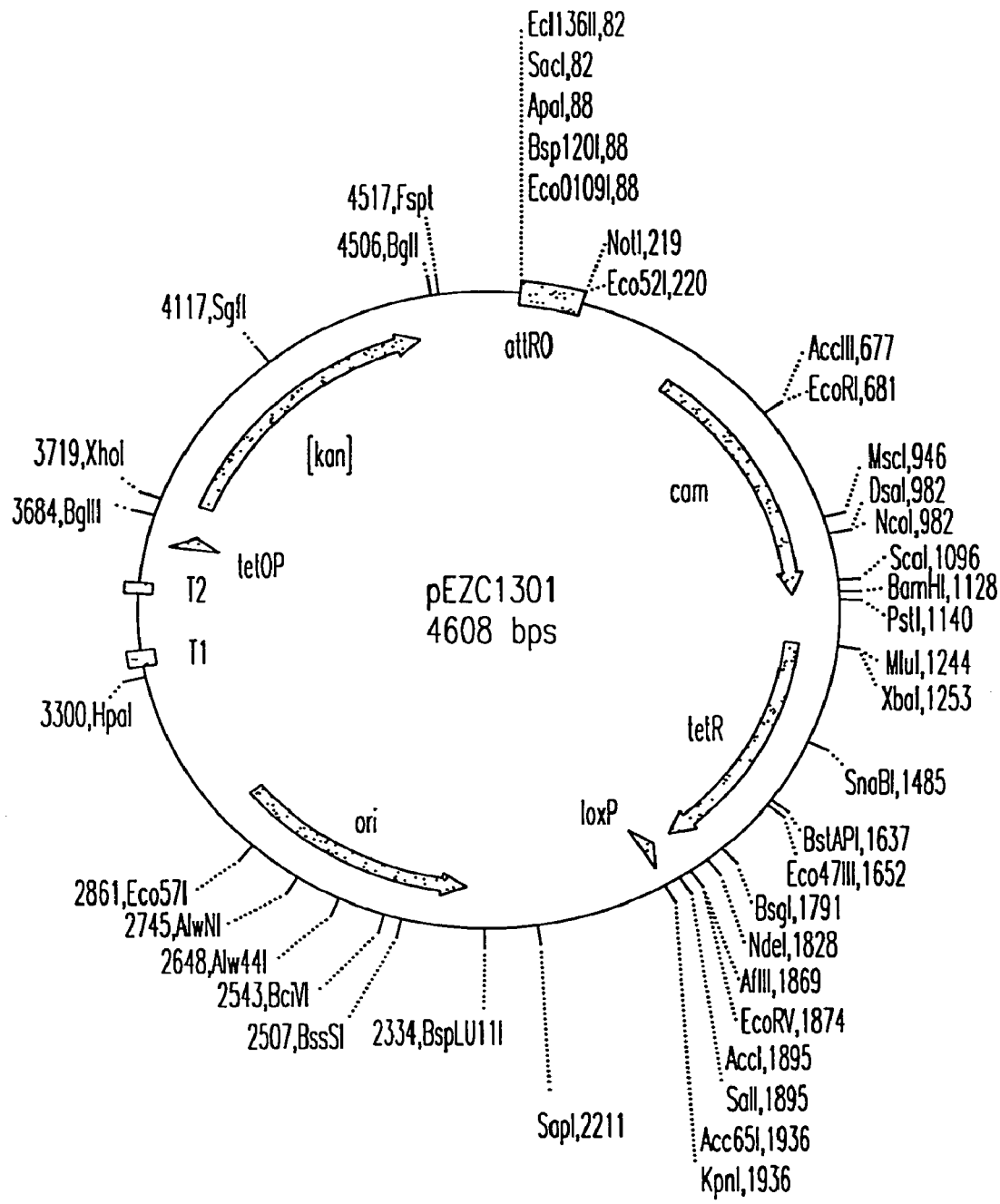
FIG. 84 is a physical map of plasmid pEZC1301.
Figure 85:
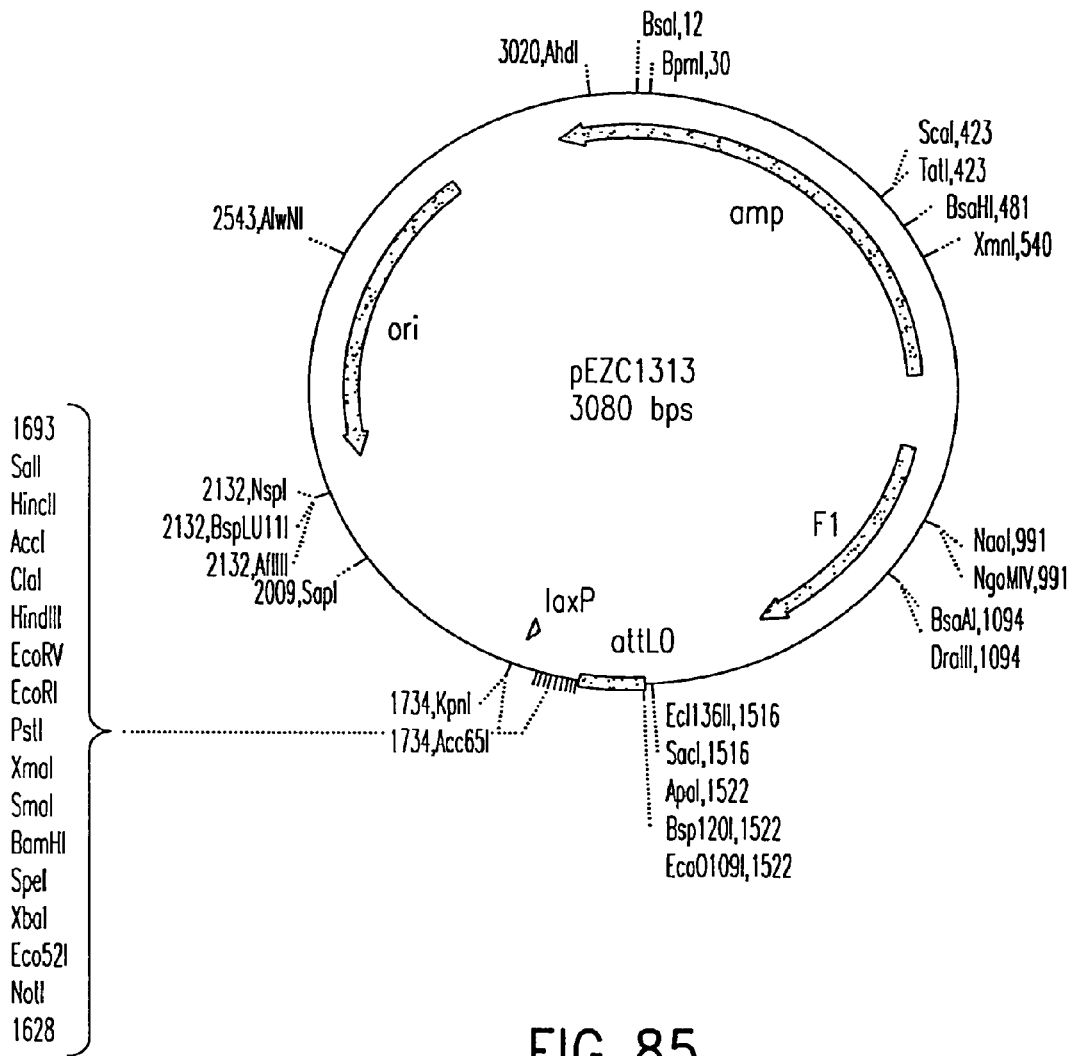
FIG. 85 is a physical map of plasmid pEZC1313.
Figure 86:
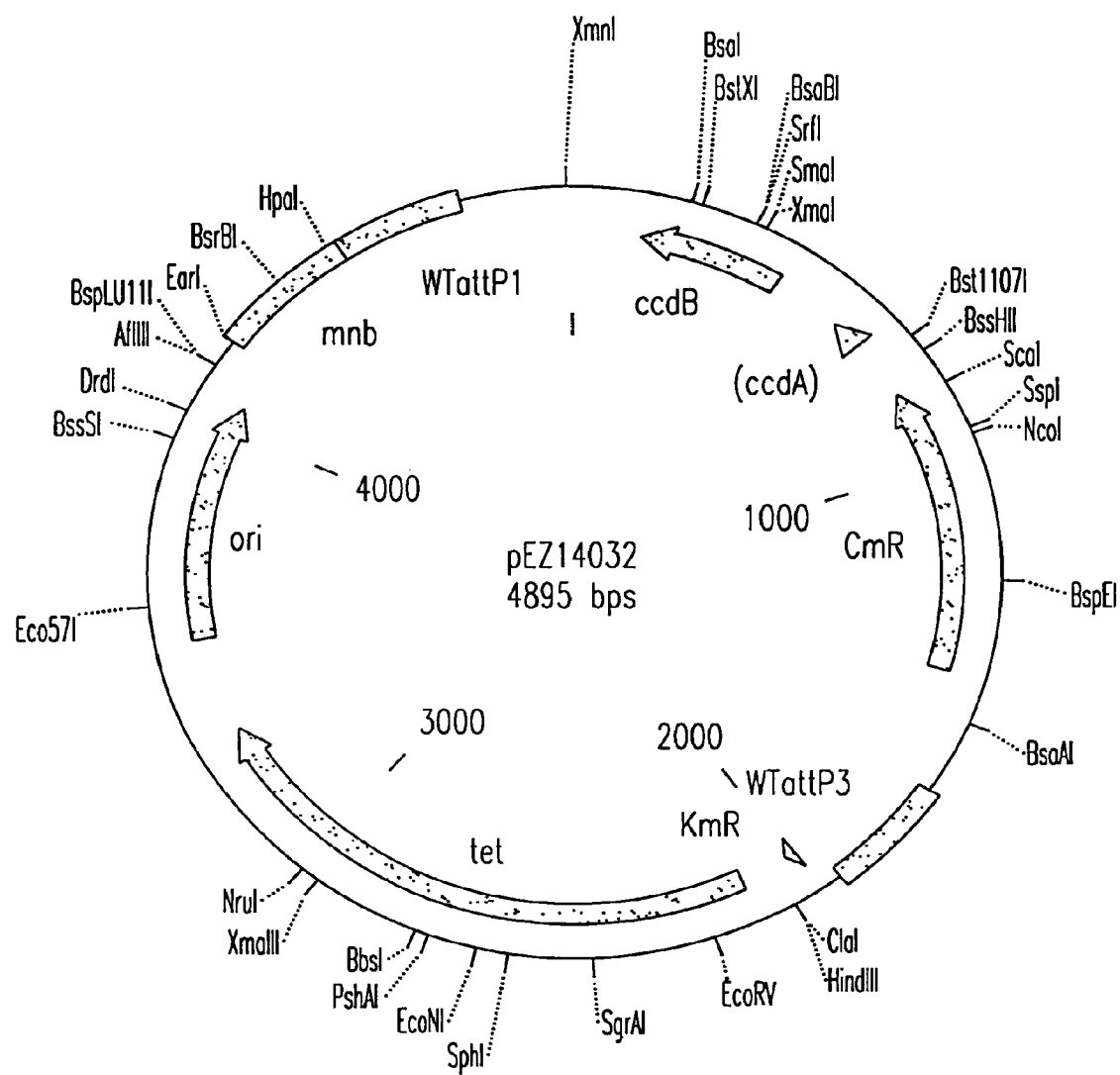
FIG. 86 is a physical map of plasmid pEZ14032.

Materials and Methods:

Plasmid templates pEZC1301 (FIG. 84) and pEZC1313 (FIG. 85), each containing a single wild type att site, were used for the generation of PCR products containing attL or attR sites, respectively. Plasmid templates were linearized with AlwNI, phenol extracted, ethanol precipitated and dissolved in TE to a concentration of 1 ng/µl.

PCR primers (capital letters represent base changes from wildtype):

attL1
(SEQ ID NO: 36)
gggg agcct gcttttttGtacAaa gttggcatta taaaaaagca ttgc;

attL2
(SEQ ID NO: 37)
gggg agcct gctttCttGtacAaa gttggcatta taaaaaagca ttgc;

attL right
(SEQ ID NO: 38)
tgttgccggg aagctagagt aa;

attR1
(SEQ ID NO: 39)
gggg Acaag ttTgtaCaaaaaagc tgaacgaga aacgtaaaat;

attR2
(SEQ ID NO: 40)
gggg Acaag ttTgtaCaaGaaagc tgaacgaga aacgtaaaat;

attR right
(SEQ ID NO: 41)
ca gacggcatga tgaacctgaa

PCR primers were dissolved in TE to a concentration of 500 pmol/µl. Primer mixes were prepared, consisting of attL1+attLright primers, attL2+attLright primers, attR1+attRright primers, and attR2+attRright primers, each mix containing 20 pmol/µl of each primer.

PCR reactions:
1 µl plasmid template (1 ng)
1 µl primer pairs (20 pmoles of each)
3 µl of H$_2$0
45 µl of Platinum PCR SuperMix® (Life Technologies, Inc.)
  Cycling conditions (performed in MJ thermocycler):
  95° C./2 minutes
  94° C./30 seconds
  25 cycles of 58° C./30 seconds and 72° C./1.5 minutes
  72° C./5 minutes
  5° C./hold The resulting attL PCR product was 1.5 kb, and the resulting attR PCR product was 1.0 kb.

PCR reactions were PEG/MgCl$_2$ precipitated by adding 150 µl H$_2$O and 100 µl of 3×PEG/MgCl$_2$ solution followed by centrifugation. The PCR products were dissolved in 50 µl of TE. Quantification of the PCR product was performed by gel electrophoresis of 1 µl and was estimated to be 50-100 ng/µl.

Recombination reactions of PCR products containing attL or attR sites with GATEWAY™ plasmids was performed as follows:
8 µl of H$_2$O
2 µl of attL or attR PCR product (100-200 ng)
2 µl of GATEWAY™ plasmid (100 ng)
4 µl of 5× Destination buffer
4 µl of GATEWAY™ LR Clonase™ Enzyme Mix
20 µl total volume (the reactions can be scaled down to a 5 µl total volume by adjusting the volumes of the components to about ¼ of those shown above, while keeping the stoichiometries the same).

Clonase reactions were incubated at 25° C. for 2 hours. 2 µl of proteinase K (2 mg/ml) was added to stop the reaction. 10 µl was then run on a 1% agarose gel. Positive control reactions were performed by reacting attL1 PCR product (1.0 kb) with attR1 PCR product (1.5 kb) and by similarly reacting attL2 PCR product with attR2PCR product to observe the formation of a larger (2.5 kb) recombination product. Negative controls were similarly performed by reacting attL1 PCR product with attR2PCR product and vice versa or reactions of attL PCR product with an attL plasmid, etc.

In alternative assays, to test attB Entry vectors, plasmids containing single attP sites were used. Plasmids containing single att sites could also be used as recombination substrates in general to test all Entry and Destination vectors (i.e., those containing attL, attR, attB and attP sites). This would eliminate the need to do PCR reactions.

Results:

Destination and Entry plasmids when reacted with appropriate att-containing PCR products formed linear recombinant molecules that could be easily visualized on an agarose gel when compared to control reactions containing no attL or attR PCR product. Thus, the functionality of Destination and Entry vectors constructed according to the invention may be determined either by carrying out the Destination or Entry recombination reactions as depicted in FIGS. 2, 4, and 5A and 5B, or more rapidly by carrying out the linearization assay described in this Example.

Example 20

PCR Cloning Using Universal Adapter-Primers

As described herein, the cloning of PCR products using the GATEWAY™ PCR Cloning System (Life Technologies, Inc.; Rockville, Md.) requires the addition of attB sites (attB1 and attB2) to the ends of gene-specific primers used in the PCR reaction. The protocols described in the preceding Examples suggest that the user add 29 bp (25 bp containing the attB site plus four G residues) to the gene-specific primer. It would be advantageous to high volume users of the GATEWAY™ PCR Cloning System to generate attB-containing PCR product using universal attB adapter-primers in combination with shorter gene-specific primers containing a specified overlap to the adapters. The following experiments demonstrate the utility of this strategy using universal attB adapter-primers and gene-specific primers containing overlaps of various lengths from 6 bp to 18 bp. The results demonstrate that gene-specific primers with overlaps of 10 bp to 18 bp can be used successfully in PCR amplifications with universal attB adapter-primers to generate full-length PCR products. These PCR products can then be successfully cloned with high fidelity in a specified orientation using the GATEWAY™ PCR Cloning System.

Methods and Results:

To demonstrate that universal attB adapter-primers can be used with gene-specific primers containing partial attB sites in PCR reactions to generate full-length PCR product, a small 256 bp region of the human hemoglobin cDNA was chosen as a target so that intermediate sized products could be distinguished from full-length products by agarose gel electrophoresis.

The following oligonucleotides were used:

```
B1-Hgb:
                                                (SEQ ID NO: 42)
GGGG ACA AGT TTG TAC AAA AAA GCA GGC T-5'-Hgb*;

B2-Hgb:
                                                (SEQ ID NO: 43)
GGGG ACC ACT TTG TAC AAG AAA GCT GGG T-3'-Hgb**;

18B1-Hgb:
                                                (SEQ ID NO: 44)
TG TAC AAA AAA GCA GGC T-5'-Hgb;

18B2-Hgb:
                                                (SEQ ID NO: 45)
TG TAC AAG AAA GCT GGG T-3'-Hgb;

15B1-Hgb:
                                                (SEQ ID NO: 46)
AC AAA AAA GCA GGC T-5'-Hgb;

15B2-Hgb:
                                                (SEQ ID NO: 47)
AC AAG AAA GCT GGG T-3'-Hgb;

12B1-Hgb:
                                                (SEQ ID NO: 48)
AA AAA GCA GGC T-5'-Hgb;

12B2-Hgb:
                                                (SEQ ID NO: 49)
AG AAA GCT GGG T-3'-Hgb;

11B1-Hgb:
                                                (SEQ ID NO: 50)
A AAA GCA GGC T-5'-Hgb;

11B2-Hgb:
                                                (SEQ ID NO: 51)
G AAA GCT GGG T-3'-Hgb;

10B1-Hgb:
                                                (SEQ ID NO: 52)
AAA GCA GGC T-5'-Hgb;

10B2-Hgb:
                                                (SEQ ID NO: 53)
AAA GCT GGG T-3'-Hgb;

9B1-Hgb:
AA GCA GGC T-5'-Hgb

9B2-Hgb:
AA GCT GGG T-3'-Hgb

8B1-Hgb:
A GCA GGC T-5'-Hgb

8B2-Hgb:
A GCT GGG T-3'-Hgb

7B1-Hgb:
GCA GGC T-5'-Hgb

7B2-Hgb:
GCT GGG T-3'-Hgb

6B1-Hgb:
CA GGC T-5'-Hgb

6B2-Hgb:
CT GGG T-3'-Hgb attB1 adapter:
                                                (SEQ ID NO: 54)
GGGG ACA AGT TTG TAC AAA AAA GCA GGC T;

attB2 adapter:
                                                (SEQ ID NO: 55)
GGGG ACC ACT TTG TAC AAG AAA GCT GGG T;

(SEQ ID NO: 56)
*-5'-Hgb =GTC ACT AGC CTG TGG AGC AAG A;

(SEQ ID NO: 57)
**-3'-Hgb =AGG ATG GCA GAG GGA GAC GAC A
```

The aim of these experiments was to develop a simple and efficient universal adapter PCR method to generate attB containing PCR products suitable for use in the GATEWAY™ PCR Cloning System. The reaction mixtures and thermocycling conditions should be simple and efficient so that the universal adapter PCR method could be routinely applicable to any PCR product cloning application.

PCR reaction conditions were initially found that could successfully amplify predominately full-length PCR product using gene-specific primers containing 18 bp and 15 bp overlap with universal attB primers. These conditions are outlined below:

10 pmoles of gene-specific primers 10 pmoles of universal attB adapter-primers 1 ng of plasmid containing the human hemoglobin cDNA.

100 ng of human leukocyte cDNA library DNA.

5 μl of 10× PLATINUM Taq HiFi® reaction buffer (Life Technologies, Inc.)

2 μl of 50 mM $MgSO_4$

1 μl of 10 mM dNTPs 0.2 μl of PLATINUM Taq HiFi® (1.0 unit)

$H_2O$ to 50 μl total reaction volume

Cycling Conditions:

$$25x \begin{cases} 95°\text{ C.}/5 \text{ min} \\ 94°\text{ C.}/15 \text{ sec} \\ 50°\text{ C.}/30 \text{ sec} \\ 68°\text{ C.}/1 \text{ min} \\ 68°\text{ C.}/5 \text{ min} \\ 5°\text{ C.}/\text{hold} \end{cases}$$

To assess the efficiency of the method, 2 μl (1/25) of the 50 μl PCR reaction was electrophoresed in a 3% Agarose-1000 gel. With overlaps of 12 bp or less, smaller intermediate products containing one or no universal attB adapter predominated the reactions. Further optimization of PCR reaction conditions was obtained by titrating the amounts of gene-specific primers and universal attB adapter-primers. The PCR reactions were set up as outlined above except that the amounts of primers added were:
0, 1, 3 or 10 pmoles of gene-specific primers
0, 10, 30 or 100 pmoles of adapter-primers
Cycling Conditions:

$$25x \begin{cases} 95°\text{ C.}/3 \text{ min} \\ 94°\text{ C.}/15 \text{ sec} \\ 50°\text{ C.}/45 \text{ sec} \\ 68°\text{ C.}/1 \text{ min} \\ 68°\text{ C.}/5 \text{ min} \\ 5°\text{ C.}/\text{hold} \end{cases}$$

The use of limiting amounts of gene-specific primers (3 pmoles) and excess adapter-primers (30 pmoles) reduced the amounts of smaller intermediate products. Using these reaction conditions the overlap necessary to obtain predominately full-length PCR product was reduced to 12 bp. The amounts of gene-specific and adapter-primers was further optimized in the following PCR reactions:
0, 1, 2 or 3 pmoles of gene-specific primers
0, 30, 40 or 50 pmoles of adapter-primers
Cycling Conditions:

$$25x \begin{cases} 95°\text{ C.}/3 \text{ min} \\ 94°\text{ C.}/15 \text{ sec} \\ 48°\text{ C.}/45 \text{ sec} \\ 68°\text{ C.}/1 \text{ min} \\ 68°\text{ C.}/5 \text{ min} \\ 5°\text{ C.}/\text{hold} \end{cases}$$

The use of 2 pmoles of gene-specific primers and 40 pmoles of adapter-primers further reduced the amounts of intermediate products and generated predominately full-length PCR products with gene-specific primers containing an 11 bp overlap. The success of the PCR reactions can be assessed in any PCR application by performing a no adapter control. The use of limiting amounts of gene-specific primers should give faint or barely visible bands when 1/25 to 1/10 of the PCR reaction is electrophoresed on a standard agarose gel. Addition of the universal attB adapter-primers should generate a robust PCR reaction with a much higher overall yield of product.

PCR products from reactions using the 18 bp, 15 bp, 12 bp, 11 bp and 10 bp overlap gene-specific primers were purified using the CONCERT® Rapid PCR Purification System (PCR products greater than 500 bp can be PEG precipitated). The purified PCR products were subsequently cloned into an attP containing plasmid vector using the GATEWAY™ PCR Cloning System (Life Technologies, Inc.; Rockville, Md.) and transformed into *E. coli*. Colonies were selected and counted on the appropriate antibiotic media and screened by PCR for correct inserts and orientation.

Raw PCR products (unpurified) from the attB adapter PCR of a plasmid clone of part of the human beta-globin (Hgb) gene were also used in GATEWAY™ PCR Cloning System reactions. PCR products generated with the full attB B1/B2-Hgb, the 12B1/B2, 11B1/B2 and 10B1/B2 attB overlap Hgb primers were successfully cloned into the GATEWAY™ pENTR21 attP vector (FIG. 49). 24 colonies from each (24× 4=96 total) were tested and each was verified by PCR to contain correct inserts. The cloning efficiency expressed as cfu/ml is shown below:

| Primer Used | cfu/ml |
| --- | --- |
| Hgb full attB | 8,700 |
| Hgb 12 bp overlap | 21,000 |
| Hgb 11 bp overlap | 20,500 |
| Hgb 10 bp overlap | 13,500 |
| GFP control | 1,300 |

Interestingly, the overlap PCR products cloned with higher efficiency than did the full attB PCR product. Presumably, and as verified by visualization on agarose gel, the adapter PCR products were slightly cleaner than was the full attB PCR product. The differences in colony output may also reflect the proportion of PCR product molecules with intact attB sites.

Using the attB adapter PCR method, PCR primers with 12 bp attB overlaps were used to amplify cDNAs of different sizes (ranging from 1 to 4 kb) from a leukocyte cDNA library and from first strand cDNA prepared from HeLa total RNA. While three of the four cDNAs were able to be amplified by this method, a non-specific amplification product was also observed that under some conditions would interfere with the gene-specific amplification. This non-specific product was amplified in reactions containing the attB adapter-primers alone without any gene-specific overlap primers present. The non-specific amplification product was reduced by increasing the stringency of the PCR reaction and lowering the attB adapter PCR primer concentration.

These results indicate that the adapter-primer PCR approach described in this Example will work well for cloned genes. These results also demonstrate the development of a simple and efficient method to amplify PCR products that are compatible with the GATEWAY™ PCR Cloning System that allows the use of shorter gene-specific primers that partially overlap universal attB adapter-primers. In routine PCR cloning applications, the use of 12 bp overlaps is recommended. The methods described in this Example can thus reduce the length of gene-specific primers by up to 17 residues or more, resulting in a significant savings in oligonucleotide costs for high volume users of the GATEWAY™ PCR Cloning System. In addition, using the methods and assays described in this Example, one of ordinary skill can, using only routine experimentation, design and use analogous primer-adapters based on or containing other recombination sites or fragments thereof, such as attL, attR, attP, lox, FRT, etc.

Example 21

Mutational Analysis of the Bacteriophage Lambda attL and attR Sites: Determinants of att Site Specificity in Site-Specific Recombination To investigate the determinants of att site specificity, the bacteriophage lambda attL and attR sites were systematically mutagenized. As noted herein, the determinants of specificity have previously been localized to the 7 bp overlap region (TTTATAC, which is defined by the cut sites for the integrase protein and is the region where strand exchange takes place) within the 15 bp core region (GCTTTTTTATACTAA) (SEQ ID NO:58) which is identical in all four lambda att sites, attB, attP, attL and attR. This core region, however, has not heretofore been systematically mutagenized and examined to define precisely which mutations produce unique changes in att site specificity.

Therefore, to examine the effect of att sequence on site specificity, mutant attL and attR sites were generated by PCR and tested in an in vitro site-specific recombination assay. In this way all possible single base pair changes within the 7 bp overlap region of the core att site were generated as well as five additional changes outside the 7 bp overlap but within the 15 bp core att site. Each attL PCR substrate was tested in the in vitro recombination assay with each of the attR PCR substrates.

Methods

To examine both the efficiency and specificity of recombination of mutant attL and attR sites, a simple in vitro site-specific recombination assay was developed. Since the core regions of attL and attR lie near the ends of these sites, it was possible to incorporate the desired nucleotide base changes within PCR primers and generate a series of PCR products containing mutant attL and attR sites. PCR products containing attL and attR sites were used as substrates in an in vitro reaction with GATEWAY™ LR Clonase™ Enzyme Mix (Life Technologies, Inc.; Rockville, Md.). Recombination between a 1.5 kb attL PCR product and a 1.0 kb attR PCR product resulted in a 2.5 kb recombinant molecule that was monitored using agarose gel electrophoresis and ethidium bromide staining.

Plasmid templates pEZC1301 (FIG. 84) and pEZC1313 (FIG. 85), each containing a single wild type attL or attR site, respectively, were used for the generation of recombination substrates. The following list shows primers that were used in PCR reactions to generate the attL PCR products that were used as substrates in L×R Clonase reactions (capital letters represent changes from the wild-type sequence, and the underline represents the 7 bp overlap region within the 15 bp core att site; a similar set of PCR primers was used to prepare the attR PCR products containing matching mutations):
GATEWAY™ sites (note: attL2 sequence in GATEWAY™ plasmids begins "accca" while the attL2 site in this example begins "agcct" to reflect wild-type attL outside the core region.):

attL1:
(SEQ ID NO: 36)
gggg agcct gctttttGtacAaa gttggcatta taaaaa-agca ttgc attL2:
(SEQ ID NO: 37)
gggg agcct gctttCttGtacAaa gttggcatta taaaaa-agca ttgc Wild-type:

attL0:
(SEQ ID NO: 59)
gggg agcct gcttttttatactaa gttggcatta taaaaa-agca ttgc

Single base changes from wild-type:

attLT1A:
(SEQ ID NO: 60)
gggg agcct gctttAttatactaa gttggcatta taaaaa-agca ttgc attLT1C:
(SEQ ID NO: 61)
gggg agcct gctttCttatactaa gttggcatta taaaaa-agca ttgc attLT1G:
(SEQ ID NO: 62)
gggg agcct gctttGttatactaa gttggcatta taaaaa-agca ttgc attLT2A:
(SEQ ID NO: 63)
gggg agcct gcttttAtatactaa gttggcatta taaaaa-agca ttgc attLT2C:
(SEQ ID NO: 64)
gggg agcct gcttttCtatactaa gttggcatta taaaaa-agca ttgc attLT2G:
(SEQ ID NO: 65)
gggg agcct gcttttGtatactaa gttggcatta taaaa-aagca ttgc attLT3A:
(SEQ ID NO: 66)
gggg agcct gctttttAatactaa gttggcatta taaaa-aagca ttgc attLT3C:
(SEQ ID NO: 67)
gggg agcct gctttttCatactaa gttggcatta taaaa-aagca ttgc attLT3G:
(SEQ ID NO: 68)
gggg agcct gctttttGatactaa gttggcatta taaaa-aagca ttgc attLA4C:
(SEQ ID NO: 69)
gggg agcct gcttttttCtactaa gttggcatta taaaa-aagca ttgc attLA4G:
(SEQ ID NO: 70)
gggg agcct gcttttttGtactaa gttggcatta taaaa-aagca ttgc attLA4T:
(SEQ ID NO: 71)
gggg agcct gcttttttTtactaa gttggcatta taaaa-aagca ttgc attLT5A:
(SEQ ID NO: 72)
gggg agcct gcttttttaAactaa gttggcatta taaaa-aagca ttgc -continued attLT5C:
(SEQ ID NO: 73)
gggg agcct gctttttta*C*actaa gttggcatta taaaa-aagca
ttgc attLT5G:
(SEQ ID NO: 74)
gggg agcct gctttttta*G*actaa gttggcatta taaaa-aagca
ttgc attLA6C:
(SEQ ID NO: 75)
gggg agcct gcttttttat*C*ctaa gttggcatta taaaa-aagca
ttgc attLA6G:
(SEQ ID NO: 76)
gggg agcct gcttttttat*G*ctaa gttggcatta taaaa-aagca
ttgc attLA6T:
(SEQ ID NO: 77)
gggg agcct gcttttttat*T*ctaa gttggcatta taaaa-aagca
ttgc attLC7A:
(SEQ ID NO: 78)
gggg agcct gcttttttata*A*taa gttggcatta taaaa-aagca
ttgc attLC7G:
(SEQ ID NO: 79)
gggg agcct gcttttttata*G*taa gttggcatta taaaa-aagca
ttgc attLC7T:
(SEQ ID NO: 80)
gggg agcct gcttttttata*T*taa gttggcatta taaaa-aagca
ttgc Single base changes outside of the 7 bp overlap:

attL8:
(SEQ ID NO: 81)
gggg agcct *A*cttttttatactaa gttggcatta taaaa-aagca
ttgc attL9:
(SEQ ID NO: 82)
gggg agcct gc*C*ttttttatactaa gttggcatta taaaaa-agca
ttgc attL10:
(SEQ ID NO: 83)
gggg agcct gcttC*tttatactaa gttggcatta taaaaa-agca
ttgc attL14:
(SEQ ID NO: 84)
gggg agcct gcttttttatac*C*aa gttggcatta taaaaa-agca
ttgc attL15:
(SEQ ID NO: 85)
gggg agcct gcttttttatacta*G* gttggcatta taaaaa-agca
ttgc Note: additional vectors wherein the first nine bases are gggg agcca (i.e., substituting an adenine for the thymine in the position immediately preceding the 15-bp core region), which may or may not contain the single base pair substitutions (or deletions) outlined above, can also be used in these experiments.

Recombination reactions of attL- and attR-containing PCR products was performed as follows:
8 µL of H$_2$O
2 µl of attL PCR product (100 ng)
2 µl of attR PCR product (100 ng)
4 µl of 5× buffer
4 µl of GATEWAY™ LR Clonase™ Enzyme Mix
20 µl total volume Clonase reactions were incubated at 25° C. for 2 hours.
2 µl of 10× Clonase stop solution (proteinase K, 2 mg/ml) were added to stop the reaction.
10 µl were run on a 1% agarose gel.

Results

Each attL PCR substrate was tested in the in vitro recombination assay with each of the attR PCR substrates. Changes within the first three positions of the 7 bp overlap (TTTATAC) strongly altered the specificity of recombination. These mutant att sites each recombined as well as the wild-type, but only with their cognate partner mutant; they did not recombine detectably with any other att site mutant. In contrast, changes in the last four positions (TTTATAC) only partially altered specificity; these mutants recombined with their cognate mutant as well as wild-type att sites and recombined partially with all other mutant att sites except for those having mutations in the first three positions of the 7 bp overlap. Changes outside of the 7 bp overlap were found not to affect specificity of recombination, but some did influence the efficiency of recombination.

Based on these results, the following rules for att site specificity were determined:
Only changes within the 7 bp overlap affect specificity.
Changes within the first 3 positions strongly affect specificity.
Changes within the last 4 positions weakly affect specificity.

Mutations that affected the overall efficiency of the recombination reaction were also assessed by this method. In these experiments, a slightly increased (less than 2-fold) recombination efficiency with attLT1A and attLC7T substrates was observed when these substrates were reacted with their cognate attR partners. Also observed were mutations that decreased recombination efficiency (approximately 2-3 fold), including attLA6G, attL14 and attL15. These mutations presumably reflect changes that affect Int protein binding at the core att site.

The results of these experiments demonstrate that changes within the first three positions of the 7 bp overlap (TTTATAC) strongly altered the specificity of recombination (i.e., att sequences with one or more mutations in the first three thymidines would only recombine with their cognate partners and would not cross-react with any other att site mutation). In contrast, mutations in the last four positions (TTTATAC) only partially altered specificity (i.e., att sequences with one or more mutations in the last four base positions would cross-react partially with the wild-type att site and all other mutant att sites, except for those having mutations in one or more of the first three positions of the 7 bp overlap). Mutations outside of the 7 bp overlap were not found to affect specificity of recombination, but some were found to influence (i.e., to cause a decrease in) the efficiency of recombination.

Example 22

Discovery of Att Site Mutations that Increase the Cloning Efficiency of GATEWAY™ Cloning Reactions In experiments designed to understand the determinants of att site specificity, point mutations in the core region of attL were made. Nucleic acid molecules containing these mutated attL sequences were then reacted in an LR reaction with nucleic acid molecules containing the cognate attR site (i.e., an attR site containing a mutation corresponding to that in the attL site), and recombinational efficiency was determined as described above. Several mutations located in the core region of the att site were noted that either slightly increased (less than 2-fold) or decreased (between 2-4-fold) the efficiency of the recombination reaction (Table 3).

TABLE 3

Effects of attL mutations on Recombination Reactions.

| Site | SEQ ID NO: | Sequence | Effect on Recombination |
|---|---|---|---|
| attL0 | 86 | agcctgcttttttatactaagttggcatta | |
| attL5 | 87 | agcctgctttAttatactaagttggcatta | slightly increased |
| attL6 | 88 | agcctgcttttttataTtaagttggcatta | slightly increased |
| attL13 | 89 | agcctgcttttttatGctaagttggcatta | decreased |
| attL14 | 90 | agcctgcttttttatacCaagttggcatta | decreased |
| attL15 | 91 | agcctgcttttttatactaGgttggcatta | decreased |
| consensus | 92 | CAACTTnnTnnnAnnAAGTTG | |

It was also noted that these mutations presumably reflected changes that either increased or decreased, respectively, the relative affinity of the integrase protein for binding the core att site. A consensus sequence for an integrase core-binding site (CAACTTNNT) has been inferred in the literature but not directly tested (see, e.g., Ross and Landy, Cell 33:261-272 (1983)). This consensus core integrase-binding sequence was established by comparing the sequences of each of the four core att sites found in attP and attB as well as the sequences of five non-att sites that resemble the core sequence and to which integrase has been shown to bind in vitro. These experiments suggest that many more att site mutations might be identified which increase the binding of integrase to the core att site and thus increase the efficiency of GATEWAY™ cloning reactions.

Example 23

Effects of Core Region Mutations on Recombination Efficiency

To directly compare the cloning efficiency of mutations in the att site core region, single base changes were made in the attB2 site of an attB1-TET-attB2 PCR product. Nucleic acid molecules containing these mutated attB2 sequences were then reacted in a BP reaction with nucleic acid molecules containing non-cognate attP sites (i.e., wildtype attP2), and recombinational efficiency was determined as described above The cloning efficiency of these mutant attB2 containing PCR products compared to standard attB1-TET-attB2 PCR product are shown in Table 4.

TABLE 4

Efficiency of Recombination With Mutated attB2 Sites.

| Site | SEQ ID NO: | Sequence | Mutation | Cloning Efficiency |
|---|---|---|---|---|
| attB0 | 93 | tcaagttagtataaaaaagcaggct | | |
| attB1 | 94 | ggggacaagtttgtacaaaaaagcaggct | | |
| attB2 | 95 | ggggaccactttgtacaagaaagctgggt | | 100% |
| attB2.1 | 96 | ggggaAcactttgtacaagaaagctgggt | C→A | 40% |
| attB2.2 | 97 | ggggacAactttgtacaagaaagctgggt | C→A | 131% |
| attB2.3 | 98 | ggggaccCctttgtacaagaaagctgggt | A→C | 4% |
| attB2.4 | 99 | ggggaccaAtttgtacaagaaagctgggt | C→A | 11% |
| attB2.5 | 100 | ggggaccacGttgtacaagaaagctgggt | T→G | 4% |
| attB2.6 | 101 | ggggaccactGtgtacaagaaagctgggt | T→G | 6% |
| attB2.7 | 102 | ggggaccacttGgtacaagaaagctgggt | T→G | 1% |
| attB2.8 | 103 | ggggaccactttTtacaagaaagctgggt | G→T | 0.5% |

As noted above, a single base change in the attB2.2 site increased the cloning efficiency of the attB1-TET-attB2.2 PCR product to 131% compared to the attB1-TET-attB2 PCR product. Interestingly, this mutation changes the integrase core binding site of attB2 to a sequence that matches more closely the proposed consensus sequence.

Additional experiments were performed to directly compare the cloning efficiency of an attB1-TET-attB2 PCR product with a PCR product that contained attB sites containing the proposed consensus sequence (see Example 22) of an integrase core binding site. The following attB sites were used to amplify attB-TET PCR products:

```
attB1
ggggacaagtttgtacaaaaaagcaggct  (SEQ ID NO: 104)

attB1.6
ggggacaaCtttgtacaaaaaagTTggct  SEQ ID NO: 105)

attB2
ggggaccactttgtacaagaaagctgggt  (SEQ ID NO: 106)

attB2.10
ggggacAactttgtacaagaaagTtgggt  (SEQ ID NO: 107)
```

BP reactions were carried out between 300 ng (100 fmoles) of pDONR201 (FIG. 49A) with 80 ng (80 fmoles) of attB-TET PCR product in a 20 µl volume with incubation for 1.5 hrs at 25° C., creating pENTR201-TET Entry clones. A comparison of the cloning efficiencies of the above-noted attB sites in BP reactions is shown in Table 5.

TABLE 5

Cloning efficiency of BP Reactions.

| PCR product | CFU/ml | Fold Increase |
| --- | --- | --- |
| B1-tet-B2 | 7,500 | |
| B1.6-tet-B2 | 12,000 | 1.6 x |
| B1-tet-B2.10 | 20,900 | 2.8 x |
| B1.6-tet-B2.10 | 30,100 | 4.0 x |

These results demonstrate that attB PCR products containing sequences that perfectly match the proposed consensus sequence for integrase core binding sites can produce Entry clones with four-fold higher efficiency than standard Gateway attB1 and attB2 PCR products.

The entry clones produced above were then transferred to pDEST20 (FIG. 40A) via LR reactions (300 ng (64 fmoles) pDEST20 mixed with 50 ng (77 fmoles) of the respective pENTR201-TET Entry clone in 20 µl volume; incubated for 1 hr incubation at 25° C.). The efficiencies of cloning for these reactions are compared in Table 6.

TABLE 6

Cloning Efficiency of LR Reactions.

| pENTR201-TET x pDEST20 | CFU/ml | Fold Increase |
| --- | --- | --- |
| L1-tet-L2 | 5,800 | |
| L1.6-tet-L2 | 8,000 | 1.4 |
| L1-tet-L2.10 | 10,000 | 1.7 |
| L1.6-tet-L2.10 | 9,300 | 1.6 |

These results demonstrate that the mutations introduced into attB1.6 and attB2.10 that transfer with the gene into entry clones slightly increase the efficiency of LR reactions. Thus, the present invention encompasses not only mutations in attB sites that increase recombination efficiency, but also to the corresponding mutations that result in the attL sites created by the BP reaction.

To examine the increased cloning efficiency of the attB1.6-TET-attB2.10 PCR product over a range of PCR product amounts, experiments analogous to those described above were performed in which the amount of attB PCR product was titrated into the reaction mixture. The results are shown in Table 7.

TABLE 7

Titration of attB PCR products.

| Amount of attB PCR product (ng) | PCR product | CFU/ml | Fold Increase |
| --- | --- | --- | --- |
| 20 | attB1-TET-attB2 | 3,500 | 6.1 |
| | attB1.6-TET-attB2.10 | 21,500 | |
| 50 | attB1-TET-attB2 | 9,800 | 5.0 |
| | attB1.6-TET-attB2.10 | 49,000 | |
| 100 | attB1-TET-attB2 | 18,800 | 2.8 |
| | attB1.6-TET-attB2.10 | 53,000 | |
| 200 | attB1-TET-attB2 | 19,000 | 2.5 |
| | attB1.6-TET-attB2.10 | 48,000 | |

These results demonstrate that as much as a six-fold increase in cloning efficiency is achieved with the attB1.6-TET-attB2.10 PCR product as compared to the standard attB1-TET-attB2 PCR product at the 20 ng amount.

Example 24

Determination of attB Sequence Requirements for Optimum Recombination Efficiency To examine the sequence requirements for attB and to determine which attB sites would clone with the highest efficiency from populations of degenerate attB sites, a series of experiments was performed. Degenerate PCR primers were designed which contained five bases of degeneracy in the B-arm of the attB site. These degenerate sequences would thus transfer with the gene into Entry clone in BP reactions and subsequently be transferred with the gene into expression clones in LR reactions. The populations of degenerate attB and attL sites could thus be cycled from attB to attL back and forth for any number of cycles. By altering the reaction conditions at each transfer step (for example by decreasing the reaction time and/or decreasing the concentration of DNA) the reaction can be made increasingly more stringent at each cycle and thus enrich for populations of attB and attL sites that react more efficiently.

The following degenerate PCR primers were used to amplify a 500 bp fragment from pUC18 which contained the lacZ alpha fragment (only the attB portion of each primer is shown):

```
attB1
GGGG ACAAGTTTGTACAAA AAAGC AGGCT  (SEQ ID NO: 108)

attB1n16-20
GGGG ACAAGTTTGTACAAA nnnnn-AGGCT  (SEQ ID NO: 109)

attB1n21-25
GGGG ACAAGTTTGTACAAA AAAGC-nnnnn  (SEQ ID NO: 110)

attB2
GGGG ACCACTTTGTACAAG AAAGC TGGGT   (SEQ ID NO: 111)
```

```
attB2n16-20
GGGG ACCACTTTGTACAAG nnnnn-TGGGT (SEQ ID NO: 112)

attB2n21-25
GGGG ACCACTTTGTACAAG AAAGC-nnnnn (SEQ ID NO: 113)
```

The starting population size of degenerate att sites is $4^5$ or 1024 molecules. Four different populations were transferred through two BP reactions and two LR reactions. Following transformation of each reaction, the population of transformants was amplified by growth in liquid media containing the appropriate selection antibiotic. DNA was prepared from the population of clones by alkaline lysis miniprep and used in the next reaction. The results of the BP and LR cloning reactions are shown below.

BP-1, overnight reactions

|  | cfu/ml | percent of control |
| --- | --- | --- |
| attB1-LacZa-attB2 | 78,500 | 100% |
| attB1n16-20-LacZa-attB2 | 1,140 | 1.5% |
| attB1n21-25-LacZa-attB2 | 11,100 | 14% |
| attB1-LacZa-attB2n16-20 | 710 | 0.9% |
| attB1-LacZa-attB2n21-25 | 16,600 | 21% |

LR-1, pENTR201—LacZa×pDEST20/EcoRI, 1 hr reactions

|  | cfu/ml | percent of control |
| --- | --- | --- |
| attL1-LacZa-attL2 | 20,000 | 100% |
| attL1n16-20-LacZa-attL2 | 2,125 | 11% |
| attL1n21-25-LacZa-attL2 | 2,920 | 15% |
| attL1-LacZa-attL2n16-20 | 3,190 | 16% |
| attL1-LacZa-attL2n21-25 | 1,405 | 7% |

BP-2, pEXP20-LacZa/ScaI×pDONR 201, 1 hr reactions

|  | cfu/ml | percent of control |
| --- | --- | --- |
| attB1-LacZa-attB2 | 48,600 | 100% |
| attB1n16-20-LacZa-attB2 | 22,800 | 47% |
| attB1n21-25-LacZa-attB2 | 31,500 | 65% |
| attB1-LacZa-attB2n16-20 | 42,400 | 87% |
| attB1-LacZa-attB2n21-25 | 34,500 | 71% |

LR-2, pENTR201—LacZa×pDEST6/NcoI, 1 hr reactions

|  | cfu/ml | percent of control |
| --- | --- | --- |
| attL1-LacZa-attL2 | 23,000 | 100% |
| attL1n16-20-LacZa-attL2 | 49,000 | 213% |
| attL1n21-25-LacZa-attL2 | 18,000 | 80% |
| attL1-LacZa-attL2n16-20 | 37,000 | 160% |
| attL1-LacZa-attL2n21-25 | 57,000 | 250% |

These results demonstrate that at each successive transfer, the cloning efficiency of the entire population of att sites increases, and that there is a great deal of flexibility in the definition of an attB site. Specific clones may be isolated from the above reactions, tested individually for recombination efficiency, and sequenced. Such new specificities may then be compared to known examples to guide the design of new sequences with new recombination specificities. In addition, based on the enrichment and screening protocols described herein, one of ordinary skill can easily identify and use sequences in other recombination sites, e.g., other att sites, lox, FRT, etc., that result in increased specificity in the recombination reactions using nucleic acid molecules containing such sequences.

Example 25

Design of att Site PCR Adapter-Primers

Additional studies were performed to design gene-specific primers with 12 bp of attB1 and attB2 at their 5'-ends. The optimal primer design for att-containing primers is the same as for any PCR primers: the gene-specific portion of the primers should ideally have a Tm of >50° C. at 50 mM salt (calculation of Tm is based on the formula 59.9+41(% GC)−675/n).

Primers:

```
12bp attB1 (SEQ ID NO: 114):
AA AAA GCA GGC TNN - forward gene-specific primer 12bp attB2 (SEQ ID NO: 115):
A GAA AGC TGG GTN - reverse gene-specific primer attB1 adapter primer (SEQ ID NO: 116):
GGGGACAAGTTTGTACAAAAAA-GCAGGCT attB2 adapter primer (SEQ ID NO: 117):
GGGGACCACTTTGTACAAGAAA-GCTGGGT
```

Protocol:

(1) Mix 200 ng of cDNA library or 1 ng of plasmid clone DNA (alternatively, genomic DNA or RNA could be used) with 10 pmoles of gene specific primers in a 50 μl PCR reaction, using one or more polypeptides having DNA polymerase activity such as those described herein. (The addition of greater than 10 pmoles of gene-specific primers can decrease the yield of attB PCR product. In addition, if RNA is used, a standard reverse transcriptase-PCR(RT-PCR) protocol should be followed; see, e.g., Gerard, G. F., et al., *FOCUS* 11:60 (1989); Myers, T. W., and Gelfand, D. H., *Biochem.* 30:7661 (1991); Freeman, W. N., et al., *BioTechniques* 20:782 (1996); and U.S. application Ser. No. 09/064,057, filed Apr. 22, 1998, the disclosures of all of which are incorporated herein by reference.)

$1^{st}$ PCR Profile:

(a) 95° C. for 3 minutes
(b) 10 cycles of:
   (i) 94° C. for 15 seconds
   (ii) 50° C.* for 30 seconds
   (iii) 68° C. for 1 minute/kb of target amplicon
(c) 68° C. for 5 minutes
(d) 10° C. hold

*The optimal annealing temperature is determined by the calculated Tm of the gene-specific part of the primer.

(2) Transfer 10 μl to a 40 μl PCR reaction mix containing 35 pmoles each of the attB1 and attB2 adapter primers.

$2^{nd}$ PCR Profile:

(a) 95° C. for 1 minute
(b) 5 cycles of:
   (i) 94° C. for 15 seconds
   (ii) 45° C.* for 30 seconds
   (iii) 68° C. for 1 minute/kb of target amplicon (c) 15-20 cycles** of:
    (i) 94° C. for 15 seconds
    (ii) 55° C.* for 30 seconds
    (iii) 68° C. for 1 minute/kb of target amplicon
(d) 68° C. for 5 minutes
(e) 10° C. hold

*The optimal annealing temperature is determined by the calculated Tm of the gene-specific part of the primer.
**15 cycles is sufficient for low complexity targets.

Notes:
1. It is useful to perform a no-adapter primer control to assess the yield of attB PCR product produced.
2. Linearized template usually results in slightly greater yield of PCR product.

Example 26

One-Tube Recombinational Cloning Using the GATEWAY™ Cloning System

To provide for easier and more rapid cloning using the GATEWAY™ cloning system, we have designed a protocol whereby the BP and LR reactions may be performed in a single tube (a "one-tube" protocol). The following is an example of such a one-tube protocol; in this example, an aliquot of the BP reaction is taken before adding the LR components, but the BP and LR reactions may be performed in a one-tube protocol without first taking the BP aliquot:

| Reaction Component | Volume |
| --- | --- |
| attB DNA (100-200 ng/25 µl reaction) | 1-12.5 µl |
| attP DNA (pDONR201) 150 ng/µl | 2.5 µl |
| 5× BP Reaction Buffer | 5.0 µl |
| Tris-EDTA | (to 20 µl) |
| BP Clonase | 5.0 µl |
| Total vol. | 25 µl |

After the above components were mixed in a single tube, the reaction mixtures were incubated for 4 hours at 25° C. A 5 µl aliquot of reaction mixture was removed, and 0.5 µl of 10× stop solution was added to this reaction mixture and incubated for 10 minutes at 37° C. Competent cells were then transformed with 1-2 µl of the BP reaction per 100 µl of cells; this transformation yielded colonies of Entry Clones for isolation of individual Entry Clones and for quantitation of the BP Reaction efficiency.

To the remaining 20 µl of BP reaction mixture, the following components of the LR reaction were added:

| Reaction Component | Final Concentration | Volume Added |
| --- | --- | --- |
| NaCl | 0.75 M | 1 µl |
| Destination Vector | 150 ng/ul | 3 µl |
| LR Clonase | | 6 µl |
| Total vol. | | 30 µl |

After the above components were mixed in a single tube, the reaction mixtures were incubated for 2 hours at 25° C. 3 µl of 10× stop solution was added, and the mixture was incubated for 10 minutes at 37° C. Competent cells were then transformed with 1-2 µl of the reaction mixture per 100 µL of cells Notes:
1. If desired, the Destination Vector can be added to the initial BP reaction.
2. The reactions can be scaled down by 2×, if desired.
3. Shorter incubation times for the BP and/or LR reactions can be used (scaled to the desired cloning efficiencies of the reaction), but a lower number of colonies will typically result.
4. To increase the number of colonies obtained by several fold, incubate the BP reaction for 6-20 hours and increase the LR reaction to 3 hours. Electroporation also works well with 1-2 ul of the PK-treated reaction mixture.
5. PCR products greater than about 5 kb may show significantly lower cloning efficiency in the BP reaction. In this case, we recommend using a one-tube reaction with longer incubation times (e.g., 6-18 hours) for both the BP and LR steps.

Example 27

Relaxation of Destination Vectors During the LR Reaction

To further optimize the LR Reaction, the composition of the LR Reaction buffer was modified from that described above and this modified buffer was used in a protocol to examine the impact of enzymatic relaxation of Destination Vectors during the LR Reaction.

LR Reactions were set up as usual (see, e.g., Example 6), except that 5× BP Reaction Buffer (see Example 5) was used for the LR Reaction. To accomplish Destination Vector relaxation during the LR Reaction, Topoisomerase I (Life Technologies, Inc., Rockville, Md.; Catalogue No. 38042-016) was added to the reaction mixture at a final concentration of ~15 U per µg of total DNA in the reaction (for example, for reaction mixtures with a total of 400 ng DNA in the 20 µl LR Reaction, ~6 units of Topoisomerase I was added). Reaction mixtures were set up as follows:

| Reaction Component | Volume |
| --- | --- |
| ddH₂O | 6.5 µl |
| 4× BP Reaction Buffer | 5 µl |
| 100 ng single chain/linear pENTR CAT, 50 ng/µl | 2 µl |
| 300 ng single chain/linear pDEST6, 150 ng/µl | 2 µl |
| Topoisomerase I, 15 U/ml | 0.5 µl |
| LR Clonase | 4 µl |

Reaction mixtures were incubated at 25° C. for 1 hour, and 2 µl of 2 µg/µl Proteinase K was then added and mixtures incubated for 10 minutes at 37° C. to stop the LR Reaction. Competent cells were then transformed as described in the preceding examples. The results of these studies demonstrated that relaxation of substrates in the LR reaction using Topoisomerase I resulted in a 2- to 10-fold increase in colony output compared to those LR reactions performed without including Topoisomerase I.

Having now fully described the present invention in some detail by way of illustration and example for purposes of clarity of understanding, it will be obvious to one of ordinary skill in the art that the same can be performed by modifying or changing the invention within a wide and equivalent range of conditions, formulations and other parameters without affecting the scope of the invention or any specific embodiment thereof, and that such modifications or changes are intended to be encompassed within the scope of the appended claims.

All publications, patents and patent applications mentioned in this specification are indicative of the level of skill of those skilled in the art to which this invention pertains, and are herein incorporated by reference to the same extent as if each individual publication, patent or patent application was specifically and individually indicated to be incorporated by reference.

SEQUENCE LISTING (303 sequences)

SEQ ID NO: 1 - DNA, 25 bp, Artificial Sequence
  Description of Artificial Sequence: Synthetic attB1 site oligonucleotide
acaagtttgtacaaaaaagcaggct

SEQ ID NO: 2 - DNA, 25 bp, Artificial Sequence
  Description of Artificial Sequence: Synthetic attB2 site oligonucleotide
acccagctttcttgtacaaagtggt

SEQ ID NO: 3 - DNA, 233 bp, Artificial Sequence
  Description of Artificial Sequence: Synthetic attP1 site polynucleotide
tacaggtcactaataccatctaagtagttgattcatagtgactggatatgttgtgttttacagtattatgtagtctgttttttatgcaaaatctaatttaatatattgatatttatatcattttacgtttctcgttcagcttttttgtacaaagttggcattataaaaaagcattgctcatcaatttgttgcaacgaacaggtcactatcagtcaaaataaaatcattatttg

SEQ ID NO: 4 - DNA, 233 bp, Artificial Sequence
  Description of Artificial Sequence: Synthetic attP2 polynucleotide
caaataatgattttattttgactgatagtgacctgttcgttgcaacaaattgataagcaatgctttcttataatgccaactttgtacaagaaagctgaacgagaaacgtaaaatgatataaatatcaatatattaaattagattttgcataaaaaacagactacataatactgtaaaacacaacatatccagtcactatgaatcaactacttagatggtattagtgacctgta

SEQ ID NO: 5 - DNA, 125 bp, Artificial Sequence
  Description of Artificial Sequence: Synthetic attL1 polynucleotide
acaagtttgtacaaaaaagctgaacgagaaacgtaaaatgatataaatatcaatatattaaattagattttgcataaaaaacagactacataatactgtaaaacacaacatatccagtcactatg

SEQ ID NO: 6 - DNA, 135 bp, Artificial Sequence
  Description of Artificial Sequence: Synthetic attL2 polynucleotide
gcaggtcgaccatagtgactggatatgttgtgttttacagtattatgtagtctgttttttatgcaaaatctaatttaatatattgatatttatatcattttacgtttctcgttcagctttcttgtacaaagtggt

SEQ ID NO: 7 - DNA, 100 bp, Artificial Sequence
  Description of Artificial Sequence: Synthetic attR1 polynucleotide
caaataatgattttattttgactgatagtgacctgttcgttgcaacaaattgataagcaatgcttttttataatgccaactttgtacaaaaaagcaggct

SEQ ID NO: 8 - DNA, 100 bp, Artificial Sequence
  Description of Artificial Sequence: Synthetic attR2 polynucleotide
caaataatgattttattttgactgatagtgacctgttcgttgcaacaaattgataagcaatgctttcttataatgccaactttgtacaagaaagctgggt

SEQ ID NO: 9 - DNA, 15 bp, Artificial Sequence
  Description of Artificial Sequence: Synthetic 15 bp core region of attB, attP, attL and attR oligonucleotide
gcttttttatactaa

SEQ ID NO: 10 - DNA, 30 bp, Artificial Sequence
  Description of Artificial Sequence: Synthetic attL5 oligonucleotide
agcctgctttattatactaagttggcatta

SEQ ID NO: 11 - DNA, 30 bp, Artificial Sequence
  Description of Artificial Sequence: Synthetic attL6 oligonucleotide
agcctgcttttttatattaagttggcatta

SEQ ID NO: 12 - DNA, 29 bp, Artificial Sequence
  Description of Artificial Sequence: Synthetic attB1.6 oligonucleotide
ggggacaactttgtacaaaaaagttggct

SEQ ID NO: 13 - DNA, 29 bp, Artificial Sequence
  Description of Artificial Sequence: Synthetic attB2.2 oligonucleotide
ggggacaactttgtacaagaaagctgggt

SEQ ID NO: 14 - DNA, 29 bp, Artificial Sequence
  Description of Artificial Sequence: Synthetic attB2.10 oligonucleotide
ggggacaactttgtacaagaaagttgggt

SEQ ID NO: 15 - DNA, 38 bp, Artificial Sequence
  Description of Artificial Sequence: Synthetic attB2(-1) primer
  modified_base (25)..(38): a, c, t, g, unknown or other
  see specification as filed for detailed description of substitutions and preferred embodiments
cccagctttcttgtacaaagtggtnnnnnnnnnnnnnn

SEQ ID NO: 16 - DNA, 38 bp, Artificial Sequence
  Description of Artificial Sequence: Synthetic attB2(-2) primer
  modified_base (24)..(38): a, c, t, g, unknown or other
  see specification as filed for detailed description of substitutions and preferred embodiments
ccagctttcttgtacaaagtggtnnnnnnnnnnnnnnn

SEQ ID NO: 17 - DNA, 38 bp, Artificial Sequence
  Description of Artificial Sequence: Synthetic attB2(-3) primer
  modified_base (23)..(38): a, c, t, g, unknown or other
  see specification as filed for detailed description of substitutions and preferred embodiments
cagctttcttgtacaaagtggtnnnnnnnnnnnnnnnn

SEQ ID NO: 18 - DNA, 38 bp, Artificial Sequence
  Description of Artificial Sequence: Synthetic attB2(-4) primer
  modified_base (22)..(38): a, c, t, g, unknown or other
  see specification as filed for detailed description of substitutions and preferred embodiments
agctttcttgtacaaagtggtnnnnnnnnnnnnnnnnn

SEQ ID NO: 19 - DNA, 39 bp, Artificial Sequence
  Description of Artificial Sequence: Synthetic attB1- and attB2-derived primer
  modified_base (26)..(39): a, c, t, g, unknown or other
  see specification as filed for detailed description of substitutions and preferred embodiments
acaagtttgtacaaaaaagcaggctnnnnnnnnnnnnnn

SEQ ID NO: 20 - DNA, 39 bp, Artificial Sequence
  Description of Artificial Sequence: Synthetic attB1- and attB2-derived primer
  modified_base (26)..(39): a, c, t, g, unknown or other
  see specification as filed for detailed description of substitutions and preferred embodiments
accactttgtacaagaaagctgggtnnnnnnnnnnnnnn

SEQ ID NO: 21 - DNA, 32 bp, Artificial Sequence
  Description of Artificial Sequence: Synthetic attB1- and attB2-derived primer
  modified_base (19)..(32): a, c, t, g, unknown or other
  see specification as filed for detailed description of substitutions and preferred embodiments
tgtacaaaaaagcaggctnnnnnnnnnnnnnn

SEQ ID NO: 22 - DNA, 32 bp, Artificial Sequence
  Description of Artificial Sequence: Synthetic attB1- and attB2-derived primer
  modified_base (19)..(32): a, c, t, g, unknown or other
  see specification as filed for detailed description of substitutions and preferred embodiments
tgtacaagaaagctgggtnnnnnnnnnnnnnn

SEQ ID NO: 23 - DNA, 29 bp, Artificial Sequence
  Description of Artificial Sequence: Synthetic attB1- and attB2-derived primer
  modified_base (16)..(29): a, c, t, g, unknown or other
  see specification as filed for detailed description of substitutions and preferred embodiments
acaaaaaagcaggctnnnnnnnnnnnnnn

SEQ ID NO: 24 - DNA, 29 bp, Artificial Sequence
  Description of Artificial Sequence: Synthetic attB1- and attB2-derived primer
  modified_base (16)..(29): a, c, t, g, unknown or other
  see specification as filed for detailed description of substitutions and preferred embodiments
acaagaaagctgggtnnnnnnnnnnnnnn

SEQ ID NO: 25 - DNA, 26 bp, Artificial Sequence
  Description of Artificial Sequence: Synthetic attB1- and attB2-derived primer
  modified_base (13)..(26): a, c, t, g, unknown or other
  see specification as filed for detailed description of substitutions and preferred embodiments
aaaaagcaggctnnnnnnnnnnnnnn

SEQ ID NO: 26 - DNA, 26 bp, Artificial Sequence
  Description of Artificial Sequence: Synthetic attB1- and attB2-derived primer
  modified_base (13)..(26): a, c, t, g, unknown or other
  see specification as filed for detailed description of substitutions and preferred embodiments
agaaagctgggtnnnnnnnnnnnnnn

SEQ ID NO: 27 - DNA, 25 bp, Artificial Sequence
  Description of Artificial Sequence: Synthetic attB1- and attB2-derived primer
  modified_base (12)..(25): a, c, t, g, unknown or other
  see specification as filed for detailed description of substitutions and preferred embodiments
aaaagcaggctnnnnnnnnnnnnnn

SEQ ID NO: 28 - DNA, 25 bp, Artificial Sequence
  Description of Artificial Sequence: Synthetic attB1- and attB2-derived primer
  modified_base (12)..(25): a, c, t, g, unknown or other
  see specification as filed for detailed description of substitutions and preferred embodiments
gaaagctgggtnnnnnnnnnnnnnn

SEQ ID NO: 29 - DNA, 24 bp, Artificial Sequence
  Description of Artificial Sequence: Synthetic attB1- and attB2-derived primer
  modified_base (11)..(24): a, c, t, g, unknown or other
  see specification as filed for detailed description of substitutions and preferred embodiments
aaagcaggctnnnnnnnnnnnnnn

SEQ ID NO: 30 - DNA, 24 bp, Artificial Sequence
  Description of Artificial Sequence: Synthetic attB1- and attB2-derived primer
  modified_base (11)..(24): a, c, t, g, unknown or other
  see specification as filed for detailed description of substitutions and preferred embodiments
aaagctgggtnnnnnnnnnnnnnn

SEQ ID NO: 31 - DNA, 29 bp, Artificial Sequence
  Description of Artificial Sequence: Synthetic attB1 primer
ggggacaagtttgtacaaaaaagcaggct

SEQ ID NO: 32 - DNA, 29 bp, Artificial Sequence
  Description of Artificial Sequence: Synthetic attB2 primer
ggggaccactttgtacaagaaagctgggt

SEQ ID NO: 33 - DNA, 27 bp, Artificial Sequence
  Description of Artificial Sequence: Synthetic XhoI Insertion primer
  modified_base (4)..(12): a, c, t, g, unknown or other
  modified_base (22)..(27): a, c, t, g, unknown or other
atgnnnnnnnnntaactcgagnnnnnn

SEQ ID NO: 34 - protein, 30 aa, Artificial Sequence
  Description of Artificial Sequence: Synthetic attB1 fused into a His6 fusion vector polypeptide
MSYYHHHHHHGITSLYKKAGFENLYFQGTM

SEQ ID NO: 35 - protein, 11 aa, Artificial Sequence
  Description of Artificial Sequence: Synthetic attB Amino Acid Sequence peptide
GITSLYKKAGF

SEQ ID NO: 36 - DNA, 48 bp, Artificial Sequence
  Description of Artificial Sequence: Synthetic attL1 PCR primer
ggggagcctgcttttttgtacaaagttggcattataaaaaagcattgc

SEQ ID NO: 37 - DNA, 48 bp, Artificial Sequence
  Description of Artificial Sequence: Synthetic attL2 PCR primer
ggggagcctgctttcttgtacaaagttggcattataaaaaagcattgc

SEQ ID NO: 38 - DNA, 22 bp, Artificial Sequence
  Description of Artificial Sequence: Synthetic attL Right PCR primer
tgttgccgggaagctagagtaa

SEQ ID NO: 39 - DNA, 43 bp, Artificial Sequence
  Description of Artificial Sequence: Synthetic attR1 PCR primer
ggggacaagtttgtacaaaaaagctgaacgagaaacgtaaaat

SEQ ID NO: 40 - DNA, 43 bp, Artificial Sequence
  Description of Artificial Sequence: Synthetic attR2 oligonucleotide
ggggacaagtttgtacaagaaagctgaacgagaaacgtaaaat

SEQ ID NO: 41 - DNA, 22 bp, Artificial Sequence
  Description of Artificial Sequence: Synthetic attR Right oligonucleotide
cagacggcatgatgaacctgaa

SEQ ID NO: 42 - DNA, 29 bp, Artificial Sequence
  Description of Artificial Sequence: Synthetic B1-Hgb oligonucleotide
ggggacaagtttgtacaaaaaagcaggct

SEQ ID NO: 43 - DNA, 29 bp, Artificial Sequence
  Description of Artificial Sequence: Synthetic B2-Hgb oligonucleotide
ggggaccactttgtacaagaaagctgggt

SEQ ID NO: 44 - DNA, 18 bp, Artificial Sequence
  Description of Artificial Sequence: Synthetic 18B1-Hgb oligonucleotide
tgtacaaaaaagcaggct

SEQ ID NO: 45 - DNA, 18 bp, Artificial Sequence
  Description of Artificial Sequence: Synthetic 18B2-Hgb oligonucleotide
tgtacaagaaagctgggt

SEQ ID NO: 46 - DNA, 15 bp, Artificial Sequence
  Description of Artificial Sequence: Synthetic 15B1-Hgb oligonucleotide
acaaaaaagcaggct

SEQ ID NO: 47 - DNA, 15 bp, Artificial Sequence
  Description of Artificial Sequence: Synthetic 15B2-Hgb oligonucleotide
acaagaaagctgggt

SEQ ID NO: 48 - DNA, 12 bp, Artificial Sequence
  Description of Artificial Sequence: Synthetic 12B1-Hgb oligonucleotide
aaaaagcaggct

SEQ ID NO: 49 - DNA, 12 bp, Artificial Sequence
  Description of Artificial Sequence: Synthetic 12B2-Hgb oligonucleotide
agaaagctgggt

SEQ ID NO: 50 - DNA, 11 bp, Artificial Sequence
  Description of Artificial Sequence: Synthetic 11B1-Hgb oligonucleotide
aaaagcaggct

SEQ ID NO: 51 - DNA, 11 bp, Artificial Sequence
  Description of Artificial Sequence: Synthetic 11B2-Hgb oligonucleotide
gaaagctgggt

SEQ ID NO: 52 - DNA, 10 bp, Artificial Sequence
  Description of Artificial Sequence: Synthetic 10B1-Hgb oligonucleotide
aaagcaggct

SEQ ID NO: 53 - DNA, 10 bp, Artificial Sequence
  Description of Artificial Sequence: Synthetic 10B2-Hgb oligonucleotide
aaagctgggt

SEQ ID NO: 54 - DNA, 29 bp, Artificial Sequence
  Description of Artificial Sequence: Synthetic attB1 adapter oligonucleotide
ggggacaagtttgtacaaaaaagcaggct

SEQ ID NO: 55 - DNA, 29 bp, Artificial Sequence
  Description of Artificial Sequence: Synthetic attB2 adapter oligonucleotide
ggggaccactttgtacaagaaagctgggt

SEQ ID NO: 56 - DNA, 22 bp, Artificial Sequence
  Description of Artificial Sequence: Synthetic -5' -Hgb oligonucleotide
gtcactagcctgtggagcaaga

SEQ ID NO: 57 - DNA, 22 bp, Artificial Sequence
  Description of Artificial Sequence: Synthetic -3' -Hgb oligonucleotide
aggatggcagagggagacgaca

SEQ ID NO: 58 - DNA, 15 bp, Artificial Sequence
  Description of Artificial Sequence: Synthetic 15 bp Core Region of attB, attP, attL and attR oligonucleotide
gcttttttatactaa

SEQ ID NO: 59 - DNA, 48 bp, Artificial Sequence
  Description of Artificial Sequence: Synthetic attL0 PCR primer
ggggagcctgcttttttatactaagttggcattataaaaaagcattgc

SEQ ID NO: 60 - DNA, 48 bp, Artificial Sequence
  Description of Artificial Sequence: Synthetic attLT1A PCR primer
ggggagcctgctttattatactaagttggcattataaaaaagcattgc

SEQ ID NO: 61 - DNA, 48 bp, Artificial Sequence
  Description of Artificial Sequence: Synthetic attLT1C PCR primer
ggggagcctgctttcttatactaagttggcattataaaaaagcattgc

SEQ ID NO: 62 - DNA, 48 bp, Artificial Sequence
  Description of Artificial Sequence: Synthetic attLT1G PCR primer
ggggagcctgctttgttatactaagttggcattataaaaaagcattgc

SEQ ID NO: 63 - DNA, 48 bp, Artificial Sequence
  Description of Artificial Sequence: Synthetic attLT2A PCR primer
ggggagcctgcttttatatactaagttggcattataaaaaagcattgc

SEQ ID NO: 64 - DNA, 48 bp, Artificial Sequence
  Description of Artificial Sequence: Synthetic attLT2C PCR primer
ggggagcctgcttttctatactaagttggcattataaaaaagcattgc

SEQ ID NO: 65 - DNA, 48 bp, Artificial Sequence
  Description of Artificial Sequence: Synthetic attLT2G PCR primer
ggggagcctgcttttgtatactaagttggcattataaaaaagcattgc

SEQ ID NO: 66 - DNA, 48 bp, Artificial Sequence
  Description of Artificial Sequence: Synthetic attLT3A PCR primer
ggggagcctgctttttaatactaagttggcattataaaaaagcattgc

SEQ ID NO: 67 - DNA, 48 bp, Artificial Sequence
  Description of Artificial Sequence: Synthetic attLT3C PCR primer
ggggagcctgctttttcatactaagttggcattataaaaaagcattgc

SEQ ID NO: 68 - DNA, 48 bp, Artificial Sequence
  Description of Artificial Sequence: Synthetic attLT3G PCR primer
ggggagcctgctttttgatactaagttggcattataaaaaagcattgc

SEQ ID NO: 69 - DNA, 48 bp, Artificial Sequence
  Description of Artificial Sequence: Synthetic attLA4C PCR primer
ggggagcctgcttttttctactaagttggcattataaaaaagcattgc

SEQ ID NO: 70 - DNA, 48 bp, Artificial Sequence
  Description of Artificial Sequence: Synthetic attLA4G PCR primer
ggggagcctgcttttttgtactaagttggcattataaaaaagcattgc

SEQ ID NO: 71 - DNA, 48 bp, Artificial Sequence
  Description of Artificial Sequence: Synthetic attLA4T PCR primer
ggggagcctgcttttttttactaagttggcattataaaaaagcattgc

SEQ ID NO: 72 - DNA, 48 bp, Artificial Sequence
  Description of Artificial Sequence: Synthetic attLT5A PCR primer
ggggagcctgcttttttaaactaagttggcattataaaaaagcattgc

SEQ ID NO: 73 - DNA, 48 bp, Artificial Sequence
  Description of Artificial Sequence: Synthetic attLT5C PCR primer
ggggagcctgcttttttacactaagttggcattataaaaaagcattgc

SEQ ID NO: 74 - DNA, 48 bp, Artificial Sequence
  Description of Artificial Sequence: Synthetic attLT5G PCR primer
ggggagcctgcttttttagactaagttggcattataaaaaagcattgc

SEQ ID NO: 75 - DNA, 48 bp, Artificial Sequence
  Description of Artificial Sequence: Synthetic attLA6C PCR primer
ggggagcctgcttttttatcctaagttggcattataaaaaagcattgc

SEQ ID NO: 76 - DNA, 48 bp, Artificial Sequence
  Description of Artificial Sequence: Synthetic attLA6G PCR primer
ggggagcctgcttttttatgctaagttggcattataaaaaagcattgc

SEQ ID NO: 77 - DNA, 48 bp, Artificial Sequence
  Description of Artificial Sequence: Synthetic attLA6T PCR primer
ggggagcctgcttttttattctaagttggcattataaaaaagcattgc

SEQ ID NO: 78 - DNA, 48 bp, Artificial Sequence
  Description of Artificial Sequence: Synthetic attLC7A PCR primer
ggggagcctgcttttttataataagttggcattataaaaaagcattgc

SEQ ID NO: 79 - DNA, 48 bp, Artificial Sequence
  Description of Artificial Sequence: Synthetic attLC7G PCR primer
ggggagcctgcttttttatagtaagttggcattataaaaaagcattgc

SEQ ID NO: 80 - DNA, 48 bp, Artificial Sequence
  Description of Artificial Sequence: Synthetic attLC7T PCR primer
ggggagcctgcttttttatattaagttggcattataaaaaagcattgc

SEQ ID NO: 81 - DNA, 48 bp, Artificial Sequence
  Description of Artificial Sequence: Synthetic attL8 oligonucleotide
ggggagcctacttttttatactaagttggcattataaaaaagcattgc

SEQ ID NO: 82 - DNA, 48 bp, Artificial Sequence
  Description of Artificial Sequence: Synthetic attL9 oligonucleotide
ggggagcctgcctttttatactaagttggcattataaaaaagcattgc

SEQ ID NO: 83 - DNA, 48 bp, Artificial Sequence
  Description of Artificial Sequence: Synthetic attL10 oligonucleotide
ggggagcctgcttctttatactaagttggcattataaaaaagcattgc

SEQ ID NO: 84 - DNA, 48 bp, Artificial Sequence
  Description of Artificial Sequence: Synthetic attL14 oligonucleotide
ggggagcctgcttttttataccaagttggcattataaaaaagcattgc

SEQ ID NO: 85 - DNA, 48 bp, Artificial Sequence
  Description of Artificial Sequence: Synthetic attL15 oligonucleotide
ggggagcctgcttttttatactaggttggcattataaaaaagcattgc

SEQ ID NO: 86 - DNA, 30 bp, Artificial Sequence
  Description of Artificial Sequence: Synthetic attL0 oligonucleotide
agcctgcttttttatactaagttggcatta

SEQ ID NO: 87 - DNA, 30 bp, Artificial Sequence; identical to SEQ ID NO: 10
  Description of Artificial Sequence: Synthetic attL5 oligonucleotide

SEQ ID NO: 88 - DNA, 30 bp, Artificial Sequence; identical to SEQ ID NO: 11
  Description of Artificial Sequence: Synthetic attL6 oligonucleotide

SEQ ID NO: 89 - DNA, 30 bp, Artificial Sequence
  Description of Artificial Sequence: Synthetic attL13 oligonucleotide
agcctgcttttttatgctaagttggcatta

SEQ ID NO: 90 - DNA, 30 bp, Artificial Sequence
  Description of Artificial Sequence: Synthetic attL14 oligonucleotide
agcctgcttttttataccaagttggcatta

SEQ ID NO: 91 - DNA, 30 bp, Artificial Sequence
  Description of Artificial Sequence: Synthetic attL15 oligonucleotide
agcctgcttttttatactaggttggcatta

SEQ ID NO: 92 - DNA, 21 bp, Artificial Sequence
  Description of Artificial Sequence: Synthetic consensus sequence for integrase core-binding
  modified_base (7)..(8): a, c, t, g, unknown or other
  modified_base (10)..(12): a, c, t, g, unknown or other
  modified_base (14)..(15): a, c, t, g, unknown or other
caacttnntnnnannaagttg

SEQ ID NO: 93 - DNA, 25 bp, Artificial Sequence
  Description of Artificial Sequence: Synthetic attB0 oligonucleotide
tcaagttagtataaaaaagcaggct

SEQ ID NO: 94 - DNA, 29 bp, Artificial Sequence
  Description of Artificial Sequence: Synthetic attB1 oligonucleotide
ggggacaagtttgtacaaaaaagcaggct

SEQ ID NO: 95 - DNA, 29 bp, Artificial Sequence
  Description of Artificial Sequence: Synthetic attB2 oligonucleotide
ggggaccactttgtacaagaaagctgggt

SEQ ID NO: 96 - DNA, 29 bp, Artificial Sequence
  Description of Artificial Sequence: Synthetic attB2.1 oligonucleotide
ggggaacactttgtacaagaaagctgggt

SEQ ID NO: 97 - DNA, 29 bp, Artificial Sequence
  Description of Artificial Sequence: Synthetic attB2.2 oligonucleotide
ggggacaactttgtacaagaaagctgggt

SEQ ID NO: 98 - DNA, 29 bp, Artificial Sequence
  Description of Artificial Sequence: Synthetic attB2.3 oligonucleotide
ggggacccctttgtacaagaaagctgggt

SEQ ID NO: 99 - DNA, 29 bp, Artificial Sequence
  Description of Artificial Sequence: Synthetic attB2.4 oligonucleotide
ggggaccaatttgtacaagaaagctgggt

SEQ ID NO: 100 - DNA, 29 bp, Artificial Sequence
  Description of Artificial Sequence: Synthetic attB2.5 oligonucleotide
ggggaccacgttgtacaagaaagctgggt

SEQ ID NO: 101 - DNA, 29 bp, Artificial Sequence
  Description of Artificial Sequence: Synthetic attB2.6 oligonucleotide
ggggaccactgtgtacaagaaagctgggt

SEQ ID NO: 102 - DNA, 29 bp, Artificial Sequence
  Description of Artificial Sequence: Synthetic attB2.7 oligonucleotide
ggggaccacttggtacaagaaagctgggt

SEQ ID NO: 103 - DNA, 29 bp, Artificial Sequence
  Description of Artificial Sequence: Synthetic attB2.8 oligonucleotide
ggggaccactttttacaagaaagctgggt

SEQ ID NO: 104 - DNA, 29 bp, Artificial Sequence
  Description of Artificial Sequence: Synthetic attB1 Amplification Site oligonucleotide
ggggacaagtttgtacaaaaaagcaggct

SEQ ID NO: 105 - DNA, 29 bp, Artificial Sequence
  Description of Artificial Sequence: Synthetic attB1.6 Amplification Site oligonucleotide
ggggacaactttgtacaaaaaagttggct

SEQ ID NO: 106 - DNA, 29 bp, Artificial Sequence
  Description of Artificial Sequence: Synthetic attB2 Amplification Site oligonucleotide
ggggaccactttgtacaagaaagctgggt

SEQ ID NO: 107 - DNA, 29 bp, Artificial Sequence
  Description of Artificial Sequence: Synthetic attB2.10 Amplification Site oligonucleotide
ggggacaactttgtacaagaaagttgggt

SEQ ID NO: 108 - DNA, 29 bp, Artificial Sequence
  Description of Artificial Sequence: Synthetic attB1 PCR primer
ggggacaagtttgtacaaaaaagcaggct

SEQ ID NO: 109 - DNA, 29 bp, Artificial Sequence
  Description of Artificial Sequence: Synthetic attB1n16-20 PCR primer
  modified_base (20)..(24): a, c, t, g, unknown or other
ggggacaagtttgtacaaannnnnaggct

SEQ ID NO: 110 - DNA, 29 bp, Artificial Sequence
  Description of Artificial Sequence: Synthetic attB1n21-25 PCR primer
  modified_base (25)..(29): a, c, t, g, unknown or other
ggggacaagtttgtacaaaaaagcnnnnn

SEQ ID NO: 111 - DNA, 29 bp, Artificial Sequence
  Description of Artificial Sequence: Synthetic attB2 PCR primer
ggggaccactttgtacaagaaagctgggt

SEQ ID NO: 112 - DNA, 29 bp, Artificial Sequence
  Description of Artificial Sequence: Synthetic attB2n16-20 PCR primer
  modified_base (20)..(24): a, c, t, g, unknown or other
ggggaccactttgtacaagnnnnntgggt

SEQ ID NO: 113 - DNA, 29 bp, Artificial Sequence
  Description of Artificial Sequence: Synthetic attB2n21-25 PCR primer
  modified_base (25)..(29): a, c, t, g, unknown or other
ggggaccactttgtacaagaaagcnnnnn

SEQ ID NO: 114 - DNA, 14 bp, Artificial Sequence
  Description of Artificial Sequence: Synthetic 12bp attB1 forward gene-specific primer
  modified_base (13)..(14): a, c, t, g, unknown or other
aaaaagcaggctnn

SEQ ID NO: 115 - DNA, 13 bp, Artificial Sequence
  Description of Artificial Sequence: Synthetic 12bp attB2 reverse gene-specific primer
  modified_base (13)..(13): a, c, t, g, unknown or other
agaaagctgggtn

SEQ ID NO: 116 - DNA, 29 bp, Artificial Sequence
  Description of Artificial Sequence: Synthetic attB1 adapter primer
ggggacaagtttgtacaaaaaagcaggct

SEQ ID NO: 117 - DNA, 29 bp, Artificial Sequence
  Description of Artificial Sequence: Synthetic attB2 adapter primer
ggggaccactttgtacaagaaagctgggt

SEQ ID NO: 118 - DNA, 2717 bp, Artificial Sequence [sequence omitted]

SEQ ID NO: 119 - DNA, 2718 bp, Artificial Sequence
  Description of Artificial Sequence: Synthetic Entry Vector pENTR2B polynucleotide
  gene (67)..(166): attL1
  gene (322)..(627): ccdB
  gene (656)..(755): attL2
  gene (878)..(1687): KmR
  gene (1792)..(2365): ori
ctgacggatggcctttttgcgtttctacaaactcttcctgttagttagttacttaagctcgggccccaaataatgattttattttgactgatagtgacctgttcgttgcaacaaattgataagcaatgcttttttataatgccaactttgtacaaaaaagcaggctggcgccggaaccaattcagtcgactggatccggtaccgaattcgcttactaaaagccagataacagtatgcgtatttgcgcgctgatttttgcggtataagaatatatactgatatgtatacccgaagtatgtcaaaaagaggtgtgcttctagaatgcagtttaaggtttacacctataaaagagagagccgttatcgtctgtttgtggatgtacagagtgatattattgacacgcccgggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatatagaattcgcggccgcactcgagatatctagacccagctttcttgtacaaagttggcattataagaaagcattgcttatcaatttgttgcaacgaacaggtcactatcagtcaaaataaaatcattatttgccatccagctgcagctctggcccgtgtctcaaaatctctgatgttacattgcacaagataaaaatatatcatcatgaacaataaaactgtctgcttacataaacagtaatacaaggggtgttatgagccatattcaacgggaaacgtcgaggccgcgattaaattccaacatggatgctgatttatatgggtataaatgggctcgcgataatgtcgggcaatcaggtgcgacaatctatcgcttgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggaaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacattattcagattgggccccgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgctagcatggatctcggggacgtctaactactaagcgagagtagggaactgccaggcatcaaataaaacgaaaggctcagtcggaagactgggcctttcgttttatctgttgtttgtcggtgaacgctctcctgagtaggacaaatccgccgggagcggatttgaacgttgtgaagcaacggcccggagggtggcgggcaggacgcccgccataaactgccaggcatcaaactaagcagaaggccatc

SEQ ID NO: 120 - DNA, 2723 bp, Artificial Sequence
  Description of Artificial Sequence: Synthetic Entry Vector pENTR3C polynucleotide
  gene (67)..(166): attL1
  gene (327)..(632): ccdB
  gene (661)..(760): attL2
  gene (883)..(1692): KmR
  gene (1797)..(2370): ori
ctgacggatggcctttttgcgtttctacaaactcttcctgttagttagttacttaagctcgggccccaaataatgattttattttgactgatagtgacctgttcgttgcaacaaattgataagcaatgcttttttataatgccaactttgtacaaaaaagcaggctctttaaaggaaccaattcagtcgactggatccggtaccgaattcgatcgcttactaaaagccagataacagtatgcgtatttgcgcgctgatttttgcggtataagaatatatactgatatgtatacccgaagtatgtcaaaaagaggtgtgcttctagaatgcagtttaaggtttacacctataaaagagagagccgttatcgtctgtttgtggatgtacagagtgatattattgacacgcccgggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatatagaattcgcggccgcactcgagatatctagacccagctttcttgtacaaagttggcattataagaaagcattgcttatcaatttgttgcaacgaacaggtcactatcagtcaaaataaaatcattatttgccatccagctgcagctctggcccgtgtctcaaaatctctgatgttacattgcacaagataaaaatatatcatcatgaacaataaaactgtctgcttacataaacagtaatacaaggggtgttatgagccatattcaacgggaaacgtcgaggccgcgattaaattccaacatggatgctgatttatatgggtataaatgggctcgcgataatgtcgggcaatcaggtgcgacaatctatcgcttgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggaaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacattattcagattgggccccgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgctagcatggatctcggggacgtctaactactaagcgagagtagggaactgccaggcatcaaataaaacgaaaggctcagtcggaagactgggcctttcgttttatctgttgtttgtcggtgaacgctctcctgagtaggacaaatccgccgggagcggatttgaacgttgtgaagcaacggcccggagggtggcgggcaggacgcccgccataaactgccaggcatcaaactaagcagaaggccatc

SEQ ID NO: 121 - DNA, 2720 bp, Artificial Sequence
  Description of Artificial Sequence: Synthetic Entry Vector pENTR4 polynucleotide
  gene (67)..(166): attL1
  gene (324)..(629): ccdB
  gene (658)..(757): attL2
  gene (880)..(1689): KmR
  gene (1794)..(2367): ori
ctgacggatggcctttttgcgtttctacaaactcttcctgttagttagttacttaagctcgggccccaaataatgattttattttgactgatagtgacctgttcgttgcaacaaattgataagcaatgcttttttataatgccaactttgtacaaaaaagcaggctccaccatgggaaccaattcagtcgactggatccggtaccgaattcgcttactaaaagccagataacagtatgcgtatttgcgcgctgatttttgcggtataagaatatatactgatatgtatacccgaagtatgtcaaaaagaggtgtgcttctagaatgcagtttaaggtttacacctataaaagagagagccgttatcgtctgtttgtggatgtacagagtgatattattgacacgcccgggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatatagaattcgcggccgcactcgagatatctagacccagctttcttgtacaaagttggcattataagaaagcattgcttatcaatttgttgcaacgaacaggtcactatcagtcaaaataaaatcattatttgccatccagctgcagctctggcccgtgtctcaaaatctctgatgttacattgcacaagataaaaatatatcatcatgaacaataaaactgtctgcttacataaacagtaatacaaggggtgttatgagccatattcaacgggaaacgtcgaggccgcgattaaattccaacatggatgctgatttatatgggtataaatgggctcgcgataatgtcgggcaatcaggtgcgacaatctatcgcttgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctggtgatgcatggttactcaccactgcgatccccggaaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacattattcagattgggccccgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgctagcatggatctcggggacgtctaactactaagcgagagtagggaactgccaggcatcaaataaaacgaaaggctcagtcggaagactgggcctttcgttttatctgttgtttgtcggtgaacgctctcctgagtaggacaaatccgccgggagcggatttgaacgttgtgaagcaacggcccggagggtggcgggcaggacgcccgccataaactgccaggcatcaaactaagcagaaggccatc

SEQ ID NO: 122 - DNA, 2720 bp, Artificial Sequence
  Description of Artificial Sequence: Synthetic Entry Vector pENTR5 polynucleotide
  gene (67)..(166): attL1
  gene (324)..(629): ccdB
  gene (658)..(757): attL2
  gene (880)..(1689): KmR
  gene (1794)..(2367): ori
ctgacggatggcctttttgcgtttctacaaactcttcctgttagttagttacttaagctcgggccccaaataatgattttattttgactgatagtgacctgttcgttgcaacaaattgataagcaatgcttttttataatgccaactttgtacaaaaaagcaggctttcatatgggaaccaattcagtcgactggatccggtaccgaattcgcttactaaaagccagataacagtatgcgtatttgcgcgctgatttttgcggtataagaatatatactgatatgtatacccgaagtatgtcaaaaagaggtgtgcttctagaatgcagtttaaggtttacacctataaaagagagagccgttatcgtctgtttgtggatgtacagagtgatattattgacacgcccgggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatatagaattcgcggccgcactcgagatatctagacccagctttcttgtacaaagttggcattataagaaagcattgcttatcaatttgttgcaacgaacaggtcactatcagtcaaaataaaatcattatttgccatccagctgcagctctggcccgtgtctcaaaatctctgatgttacattgcacaagataaaaatatatcatcatgaacaataaaactgtctgcttacataaacagtaatacaaggggtgttatgagccatattcaacgggaaacgtcgaggccgcgattaaattccaacatggatgctgatttatatgggtataaatgggctcgcgataatgtcgggcaatcaggtgcgacaatctatcgcttgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggaaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacattattcagattgggccccgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgctagcatggatctcggggacgtctaactactaagcgagagtagggaactgccaggcatcgaataaaacgaaaggctcagtcggaagactgggcctttcgttttatctgttgtttgtcggtgaacgctctcctgagtaggacaaatccgccgggagcggatttgaacgttgtgaagcaacggcccggagggtggcgggcaggacgcccgccataaactgccaggcatcaaactaagcagaaggccatc

SEQ ID NO: 123 - DNA, 2717 bp, Artificial Sequence
  Description of Artificial Sequence: Synthetic Entry Vector pENTR6 polynucleotide
  gene (67)..(166): attL1
  gene (321)..(626): ccdB
  gene (655)..(754): attL2
  gene (877)..(1686): KmR
  gene (1791)..(2364): ori
ctgacggatggcctttttgcgtttctacaaactcttcctgttagttagttacttaagctcgggccccaaataatgattttattttgactgatagtgacctgttcgttgcaacaaattgataagcaatgcttttttataatgccaactttgtacaaaaaagcaggctgcatgcgaaccaattcagtcgactggatccggtaccgaattcgcttactaaaagccagataacagtatgcgtatttgcgcgctgatttttgcggtataagaatatatactgatatgtatacccgaagtatgtcaaaaagaggtgtgcttctagaatgcagtttaaggtttacacctataaaagagagagccgttatcgtctgtttgtggatgtacagagtgatattattgacacgcccgggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatatagaattcgcggccgcactcgagatatctagacccagctttcttgtacaaagttggcattataagaaagcattgcttatcaatttgttgcaacgaacaggtcactatcagtcaaaataaaatcattatttgccatccagctgcagctctggcccgtgtctcaaaatctctgatgttacattgcacaagataaaaatatatcatcatgaacaataaaactgtctgcttacataaacagtaatacaaggggtgttatgagccatattcaacgggaaacgtcgaggccgcgattaaattccaacatggatgctgatttatatgggtataaatgggctcgcgataatgtcgggcaatcaggtgcgacaatctatcgcttgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggaaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacattattcagattgggccccgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgctagcatggatctcggggacgtctaactactaagcgagagtagggaactgccaggcatcaaataaaacgaaaggctcagtcggaagactgggcctttcgttttatctgttgtttgtcggtgaacgctctcctgagtaggacaaatccgccgggagcggatttgaacgttgtgaagcaacggcccggagggtggcgggcaggacgcccgccataaactgccaggcatcaaactaagcagaaggccatc

SEQ ID NO: 124 - DNA, 2738 bp, Artificial Sequence [sequence omitted]

SEQ ID NO: 125 - DNA, 2735 bp, Artificial Sequence [sequence omitted]

SEQ ID NO: 126 - DNA, 2735 bp, Artificial Sequence [sequence omitted]

SEQ ID NO: 127 - DNA, 2738 bp, Artificial Sequence
  Description of Artificial Sequence: Synthetic Entry Vector pENTR10 polynucleotide
  gene (67)..(166): attL1
  gene (342)..(647): ccdB
  gene (676)..(775): attL2
  gene (898)..(1707): KmR
  gene (1812)..(2385): ori
ctgacggatggcctttttgcgtttctacaaactcttcctgttagttagttacttaagctcgggccccaaataatgattttattttgactgatagtgacctgttcgttgcaacaaattgataagcaatgcttttttataatgccaactttgtacaaaaaagcaggcttcgaactaaggaaatacttacatatgggaaccaattcagtcgactggatccggtaccgaattcgcttactaaaagccagataacagtatgcgtatttgcgcgctgatttttgcggtataagaatatatactgatatgtatacccgaagtatgtcaaaaagaggtgtgcttctagaatgcagtttaaggtttacacctataaaagagagagccgttatcgtctgtttgtggatgtacagagtgatattattgacacgcccgggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatatagaattcgcggccgcactcgagatatctagacccagctttcttgtacaaagttggcattataagaaagcattgcttatcaatttgttgcaacgaacaggtcactatcagtcaaaataaaatcattatttgccatccagctgcagctctggcccgtgtctcaaaatctctgatgttacattgcacaagataaaaatatatcatcatgaacaataaaactgtctgcttacataaacagtaatacaaggggtgttatgagccatattcaacgggaaacgtcgaggccgcgattaaattccaacatggatgctgatttatatgggtataaatgggctcgcgataatgtcgggcaatcaggtgcgacaatctatcgcttgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggaaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacattattcagattgggccccgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgctagcatggatctcggggacgtctaactactaagcgagagtagggaactgccaggcatcgaataaaacgaaaggctcagtcggaagactgggcctttcgttttatctgttgtttgtcggtgaacgctctcctgagtaggacaaatccgccgggagcggatttgaacgttgtgaagcaacggcccggagggtggcgggcaggacgcccgccataaactgccaggcatcaaactaagcagaaggccatc

SEQ ID NO: 128 - DNA, 2744 bp, Artificial Sequence [sequence omitted]

SEQ ID NO: 129 - DNA, 6464 bp, Artificial Sequence
  Description of Artificial Sequence: Synthetic pDEST1 polynucleotide
  gene (216)..(257): Trc promoter
  gene (273)..(393): attR1
  gene (647)..(1306): CmR
  gene (1426)..(1510): inactivated ccdA
  gene (1648)..(1953): ccdB
  gene (1994)..(2118): attR2
  gene (2598)..(3503): ampR
  gene (4104)..(4264): ori
  gene (4504)..(4941): f1ori (f1 intergenic region)
  gene (5340)..(6420): lacIq
gtttgacagcttatcatcgactgcacggtgcaccaatgcttctggcgtcaggcagccatcggaagctgtggtatggctgtgcaggtcgtaaatcactgcataattcgtgtcgctcaaggcgcactcccgttctggataatgttttttgcgccgacatcataacggttctggcaaatattctgaaatgagctgttgacaattaatcatccggtccgtataatctgtggaattgtgagcgggataacaatttcatcgcgaggtaccaagctatcacaagtttgtacaaaaaagctgaacgagaaacgtaaaatgatataaatatcaatatattaaattagattttgcataaaaaacagactacataatactgtaaaacacaacatatccagtcactatggcggccgctaagttggcagcatcacccgacgcactttgcgccgaataaatacctgtgacggaagatcacttcgcagaataaataaatcctggtgtccctgttgataccgggaagccctgggccaacttttggcgaaaatgagacgttgatcggcacgtaagaggttccaactttcaccataatgaaataagatcactaccgggcgtattttttgagttatcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtctgtgatggcttccatgtcggcagaatgcttaatgaattacaacagtactgcgatgagtggcagggcggggcgtaaacgcgtggatccggcttactaaaagccagataacagtatgcgtatttgcgcgctgatttttgcggtataagaatatatactgatatgtatacccgaagtatgtcaaaaagaggtgtgctatgaagcagcgtattacagtgacagttgacagcgacagctatcagttgctcaaggcatatatgatgtcaatatctccggtctggtaagcacaaccatgcagaatgaagcccgtcgtctgcgtgccgaacgctggaaagcggaaaatcaggaagggatggctgaggtcgcccggtttattgaaatgaacggctcttttgctgacgagaacagggactggtgaaatgcagtttaaggtttacacctataaaagagagagccgttatcgtctgtttgtggatgtacagagtgatattattgacacgcccgggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatataaatgtcaggctcccttatacacagccagtctgcaggtcgaccatagtgactggatatgttgtgttttacagtattatgtagtctgttttttatgcaaaatctaatttaatatattgatatttatatcattttacgtttctcgttcagctttcttgtacaaagtggtgatagcttggctgttttggcggatgagagaagattttcagcctgatacagattaaatcagaacgcagaagcggtctgataaaacagaatttgcctggcggcagtagcgcggtggtcccacctgaccccatgccgaactcagaagtgaaacgccgtagcgccgatggtagtgtggggtctccccatgcgagagtagggaactgccaggcatcaaataaaacgaaaggctcagtcgaaagactgggcctttcgttttatctgttgtttgtcggtgaacgctctcctgagtaggacaaatccgccgggagcggatttgaacgttgcgaagcaacggcccggagggtggcgggcaggacgcccgccataaactgccaggcatcaaattaagcagaaggccatcctgacggatggcctttttgcgtttctacaaactctttttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctacagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcataattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgctatggtgcactctcagtacaatctgctctgatgccgcatagttaagccagtaccagtcacgtagcgatatcggagtgtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagcagatcaattcgcgcgcgaaggcgaagcggcatgcatttacgttgacaccatcgaatggtgcaaaacctttcgcggtatggcatgatagcgcccggaagagagtcaattcagggtggtgaatgtgaaaccagtaacgttatacgatgtcgcagagtatgccggtgtctcttatcagaccgtttcccgcgtggtgaaccaggccagccacgtttctgcgaaaacgcgggaaaaagtggaagcggcgatggcggagctgaattacattcccaaccgcgtggcacaacaactggcgggcaaacagtcgttgctgattggcgttgccacctccagtctggccctgcacgcgccgtcgcaaattgtcgcggcgattaaatctcgcgccgatcaactgggtgccagcgtggtggtgtcgatggtagaacgaagcggcgtcgaagcctgtaaagcggcggtgcacaatcttctcgcgcaacgcgtcagtgggctgatcattaactatccgctggatgaccaggatgccattgctgtggaagctgcctgcactaatgttccggcgttatttcttgatgtctctgaccagacacccatcaacagtattattttctcccatgaagacggtacgcgactgggcgtggagcatctggtcgcattgggtcaccagcaaatcgcgctgttagcgggcccattaagttctgtctcggcgcgtctgcgtctggctggctggcataaatatctcactcgcaatcaaattcagccgatagcggaacgggaaggcgactggagtgccatgtccggttttcaacaaaccatgcaaatgctgaatgagggcatcgttcccactgcgatgctggttgccaacgatcagatggcgctgggcgcaatgcgcgccattaccgagtccgggctgcgcgttggtgcggatatctcggtagtgggatacgacgataccgaagacagctcatgttatatcccgccgttaaccaccatcaaacaggattttcgcctgctggggcaaaccagcgtggaccgcttgctgcaactctctcagggccaggcggtgaagggcaatcagctgttgcccgtctcactggtgaaaagaaaaaccaccctggcacccaatacgcaaaccgcctctccccgcgcgttggccgattcattaatgcagctggcacgacaggtttcccgactggaaagcgggcagtgagcgcaacgcaattaatgtgagttagcgcgaattgatctg

SEQ ID NO: 130 - DNA, 6553 bp, Artificial Sequence
  Description of Artificial Sequence: Synthetic pDEST2 polynucleotide
  gene (912)..(962): Trc
  gene (1009)..(1223): attR1
  gene (1473)..(2132): CmR
  gene (2252)..(2336): inactivated ccdA
  gene (2474)..(2779): ccdB
  gene (2820)..(2944): attR2
  gene (3509)..(4414): ampR
  gene (5015)..(5175): ori
  gene (5415)..(5825): f1ori (f1 intergenic region)
  gene (752)..(6225): lacIq
ggcggtgcacaatcttctcgcgcaacgcgtcagtgggctgatcattaactatccgctggatgaccaggatgccattgctgtggaagctgcctgcactaatgttccggcgttatttcttgatgtctctgaccagacacccatcaacagtattattttctcccatgaagacggtacgcgactgggcgtggagcatctggtcgcattgggtcaccagcaaatcgcgctgttagcgggcccattaagttctgtctcggcgcgtctgcgtctggctggctggcataaatatctcactcgcaatcaaattcagccgatagcggaacgggaaggcgactggagtgccatgtccggttttcaacaaaccatgcaaatgctgaatgagggcatcgttcccactgcgatgctggttgccaacgatcagatggcgctgggcgcaatgcgcgccattaccgagtccgggctgcgcgttggtgcggatatctcggtagtgggatacgacgataccgaagacagctcatgttatatcccgccgtcaaccaccatcaaacaggattttcgcctgctggggcaaaccagcgtggaccgcttgctgcaactctctcagggccaggcggtgaagggcaatcagctgttgcccgtctcactggtgaaaagaaaaaccaccctggcacccaatacgcaaaccgcctctccccgcgcgttggccgattcattaatgcagctggcacgacaggtttcccgactggaaagcgggcagtgagcgcaacgcaattaatgtgagttagcgcgaattgatctggtttgacagcttatcatcgactgcacggtgcaccaatgcttctggcgtcaggcagccatcggaagctgtggtatggctgtgcaggtcgtaaatcactgcataattcgtgtcgctcaaggcgcactcccgttctggataatgttttttgcgccgacatcataacggttctggcaaatattctgaaatgagctgttgacaattaatcatccggtccgtataatctgtggaattgtgagcggataacaatttcacacaggaaacagaccatgtcgtactaccatcaccatcaccatcacggcatcacaagtttgtacaaaaaagctgaacgagaaacgtaaaatgatataaatatcaatatattaaattagattttgcataaaaaacagactacataatactgtaaaacacaacatatccagtcactatggcggccgctaagttggcagcatcacccgacgcactttgcgccgaataaatacctgtgacggaagatcacttcgcagaataaataaatcctggtgtccctgttgataccgggaagccctgggccaacttttggcgaaaatgagacgttgatcggcacgtaagaggttccaactttcaccataatgaaataagatcactaccgggcgtattttttgagttatcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtctgtgatggcttccatgtcggcagaatgcttaatgaattacaacagtactgcgatgagtggcagggcggggcgtaaacgcgtggatccggcttactaaaagccagataacagtatgcgtatttgcgcgctgatttttgcggtataagaatatatactgatatgtatacccgaagtatgtcaaaaagaggtgtgctatgaagcagcgtattacagtgacagttgacagcgacagctatcagttgctcaaggcatatatgatgtcaatatctccggtctggtaagcacaaccatgcagaatgaagcccgtcgtctgcgtgccgaacgctggaaagcggaaaatcaggaagggatggctgaggtcgcccggtttattgaaatgaacggctcttttgctgacgagaacagggactggtgaaatgcagtttaaggtttacacctataaaagagagagccgttatcgtctgtttgtggatgtacagagtgatattattgacacgcccgggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatataaatgtcaggctcccttatacacagccagtctgcaggtcgaccatagtgactggatatgttgtgttttacagtattatgtagtctgttttttatgcaaaatctaatttaatatattgatatttatatcattttacgtttctcgttcagctttcttgtacaaagtggtgatgcccatatgggaattcaaaggcctacgtcgacgagctcactagtcgcggccgcttctagaggatccctcgaggcatgcggtaccaagcttggctgttttggcggatgagagaagattttcagcctgatacagattaaatcagaacgcagaagcggtctgataaaacagaatttgcctggcggcagtagcgcggtggtcccacctgaccccatgccgaactcagaagtgaaacgccgtagcgccgatggtagtgtggggtctccccatgcgagagtagggaactgccaggcatcaaataaaacgaaaggctcagtcgaaagactgggcctttcgttttatctgttgtttgtcggtgaacgctctcctgagtaggacaaatccgccgggagcggatttgaacgttgcgaagcaacggcccggagggtggcgggcaggacgcccgccataaactgccaggcatcaaattaagcagaaggccatcctgacggatggcctttttgcgtttctacaaactctttttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctacagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcataattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgctatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagcagatcaattcgcgcgcgaaggcgaagcggcatgcatttacgttgacaccatcgaatggtgcaaaacctttcgcggtatggcatgatagcgcccggaagagagtcaattcagggtggtgaatgtgaaaccagtaacgttatacgatgtcgcagagtatgccggtgtctcttatcagaccgtttcccgcgtggtgaaccaggccagccacgtttctgcgaaaacgcgggaaaaagtggaagcggcgatggcggagctgaattacattcccaaccgcgtggcacaacaactggcgggcaaacagtcgttgctgattggcgttgccacctccagtctggccctgcacgcgccgtcgcaaattgtcgcggcgattaaatctcgcgccgatcaactgggtgccagcgtggtggtgtcgatggtagaacgaagcggcgtcgaagcctgtaaagc

SEQ ID NO: 131 - DNA, 6823 bp, Artificial Sequence
  Description of Artificial Sequence: Synthetic pDEST3 polynucleotide
  gene (150)..(200): Trc
  gene (963)..(1087): attR1
  gene (1337)..(1996): CmR
  gene (2116)..(2200): inactivated ccdA
  gene (2338)..(2643): ccdB
  gene (2684)..(2808): attR2
  gene (3231)..(4091): ampR
  gene (5295)..(6254): lacIq
acgttatcgactgcacggtgcaccaatgcttctggcgtcaggcagccatcggaagctgtggtatggctgtgcaggtcgtaaatcactgcataattcgtgtcgctcaaggcgcactcccgttctggataatgttttttgcgccgacatcataacggttctggcaaatattctgaaatgagctgttgacaattaatcatcggctcgtataatgtgtggaattgtgagcggataacaatttcacacaggaaacagtattcatgtcccctatactaggttattggaaaattaagggccttgtgcaacccactcgacttcttttggaatatcttgaagaaaaatatgaagagcatttgtatgagcgcgatgaaggtgataaatggcgaaacaaaaagtttgaattgggtttggagtttcccaatcttccttattatattgatggtgatgttaaattaacacagtctatggccatcatacgttatatagctgacaagcacaacatgttgggtggttgtccaaaagagcgtgcagagatttcaatgcttgaaggagcggttttggatattagatacggtgtttcgagaattgcatatagtaaagactttgaaactctcaaagttgattttcttagcaagctacctgaaatgctgaaaatgttcgaagatcgtttatgtcataaaacatatttaaatggtgatcatgtaacccatcctgacttcatgttgtatgacgctcttgatgttgttttatacatggacccaatgtgcctggatgcgttcccaaaattagtttgttttaaaaaacgtattgaagctatcccacaaattgataagtacttgaaatccagcaagtatatagcatggcctttgcagggctggcaagccacgtttggtggtggcgaccatcctccaaaatcggatctggttccgcgtggatctcgtcgtgcatctgttggatccccatcaacaagtttgtacaaaaaagctgaacgagaaacgtaaaatgatataaatatcaatatattaaattagattttgcataaaaaacagactacataatactgtaaaacacaacatatccagtcactatggcggccgctaagttggcagcatcacccgacgcactttgcgccgaataaatacctgtgacggaagatcacttcgcagaataaataaatcctggtgtccctgttgataccgggaagccctgggccaacttttggcgaaaatgagacgttgatcggcacgtaagaggttccaactttcaccataatgaaataagatcactaccgggcgtattttttgagttatcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtctgtgatggcttccatgtcggcagaatgcttaatgaattacaacagtactgcgatgagtggcagggcggggcgtaaagatctggatccggcttactaaaagccagataacagtatgcgtatttgcgcgctgatttttgcggtataagaatatatactgatatgtatacccgaagtatgtcaaaaagaggtgtgctatgaagcagcgtattacagtgacagttgacagcgacagctatcagttgctcaaggcatatatgatgtcaatatctccggtctggtaagcacaaccatgcagaatgaagcccgtcgtctgcgtgccgaacgctggaaagcggaaaatcaggaagggatggctgaggtcgcccggtttattgaaatgaacggctcttttgctgacgagaacagggactggtgaaatgcagtttaaggtttacacctataaaagagagagccgttatcgtctgtttgtggatgtacagagtgatattattgacacgcccgggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatataaatgtcaggctcccttatacacagccagtctgcaggtcgaccatagtgactggatatgttgtgttttacagtattatgtagtctgttttttatgcaaaatctaatttaatatattgatatttatatcattttacgtttctcgttcagctttcttgtacaaagtggttgatgggaattcatcgtgactgactgacgatctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtataattcttgaagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcataaattccgacaccatcgaatggtgcaaaacctttcgcggtatggcatgatagcgcccggaagagagtcaattcagggtggtgaatgtgaaaccagtaacgttatacgatgtcgcagagtatgccggtgtctcttatcagaccgtttcccgcgtggtgaaccaggccagccacgtttctgcgaaaacgcgggaaaaagtggaagcggcgatggcggagctgaattacattcccaaccgcgtggcacaacaactggcgggcaaacagtcgttgctgattggcgttgccacctccagtctggccctgcacgcgccgtcgcaaattgtcgcggcgattaaatctcgcgccgatcaactgggtgccagcgtggtggtgtcgatggtagaacgaagcggcgtcgaagcctgtaaagcggcggtgcacaatcttctcgcgcaacgcgtcagtgggctgatcattaactatccgctggatgaccaggatgccattgctgtggaagctgcctgcactaatgttccggcgttatttcttgatgtctctgaccagacacccatcaacagtattattttctcccatgaagacggtacgcgactgggcgtggagcatctggtcgcattgggtcaccagcaaatcgcgctgttagcgggcccattaagttctgtctcggcgcgtctgcgtctggctggctggcataaatatctcactcgcaatcaaattcagccgatagcggaacgggaaggcgactggagtgccatgtccggttttcaacaaaccatgcaaatgctgaatgagggcatcgttcccactgcgatgctggttgccaacgatcagatggcgctgggcgcaatgcgcgccattaccgagtccgggctgcgcgttggtgcggatatctcggtagtgggatacgacgataccgaagacagctcatgttatatcccgccgttaaccaccatcaaacaggattttcgcctgctggggcaaaccagcgtggaccgcttgctgcaactctctcagggccaggcggtgaagggcaatcagctgttgcccgtctcactggtgaaaagaaaaaccaccctggcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacggattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgctttgcctggtttccggcaccagaagcggtgccggaaagctggctggagtgcgatcttcctgaggccgatactgtcgtcgtcccctcaaactggcagatgcacggttacgatgcgcccatctacaccaacgtaacctatcccattacggtcaatccgccgtttgttcccacggagaatccgacgggttgttactcgctcacatttaatgttgatgaaagctggctacaggaaggccagacgcgaattatttttgatggcgttggaatt

SEQ ID NO: 132 - DNA, 6964 bp, Artificial Sequence
  Description of Artificial Sequence: Synthetic pDEST4 polynucleotide
  gene (704)..(6587): lacIq
  gene (964)..(1003): Trc
  gene (1453)..(1577): attR1
  gene (1827)..(2486): CmR
  gene (2606)..(2690): inactivated ccdA
  gene (2828)..(3133): ccdB
  gene (3174)..(3298): attR2
  gene (3872)..(4777): ampR
  gene (5378)..(5538): ori
  gene (5778)..(6215): f1ori (f1 intergenic region)
  modified_base (6950)..(6950): a, c, t, g, unknown or other
ctatccgctggatgaccaggatgccattgctgtggaagctgcctgcactaatgttccggcgttatttcttgatgtctctgaccagacacccatcaacagtattattttctcccatgaagacggtacgcgactgggcgtggagcatctggtcgcattgggtcaccagcaaatcgcgctgttagcgggcccattaagttctgtctcggcgcgtctgcgtctggctggctggcataaatatctcactcgcaatcaaattcagccgatagcggaacgggaaggcgactggagtgccatgtccggttttcaacaaaccatgcaaatgctgaatgagggcatcgttcccactgcgatgctggttgccaacgatcagatggcgctgggcgcaatgcgcgccattaccgagtccgggctgcgcgttggtgcggatatctcggtagtgggatacgacgataccgaagacagctcatgttatatcccgccgtcaaccaccatcaaacaggattttcgcctgctggggcaaaccagcgtggaccgcttgctgcaactctctcagggccaggcggtgaagggcaatcagctgttgcccgtctcactggtgaaaagaaaaaccaccctggcacccaatacgcaaaccgcctctccccgcgcgttggccgattcattaatgcagctggcacgacaggtttcccgactggaaagcgggcagtgagcgcaacgcaattaatgtgagttagcgcgaattgatctggtttgacagcttatcatcgactgcacggtgcaccaatgcttctggcgtcaggcagccatcggaagctgtggtatggctgtgcaggtcgtaaatcactgcataattcgtgtcgctcaaggcgcactcccgttctggataatgttttttgcgccgacatcataacggttctggcaaatattctgaaatgagctgttgacaattaatcatccggtccgtataatctgtggaattgtgagcggataacaatttcacacaggaaacagaccatgggtcatcatcatcatcatcacgattacgatatcccaacgaccgaaaacctgtattttcagggcgcccatatgagcgataaaattattcacctgactgacgacagttttgacacggatgtactcaaagcggacggggcgatcctcgtcgatttctgggcagagtggtgcggtccgtgcaaaatgatcgccccgattctggatgaaatcgctgacgaatatcagggcaaactgaccgttgcaaaactgaacatcgatcaaaaccctggcactgcgccgaaatatggcatccgtggtatcccgactctgctgctgttcaaaaacggtgaagtggcggcaaccaaagtgggtgcactgtctaaaggtcagttgaaagagttcctcgacgctaacctggccggttctggttctggtgatgacgatgacaaggtacccatcacaagtttgtacaaaaaagctgaacgagaaacgtaaaatgatataaatatcaatatattaaattagattttgcataaaaaacagactacataatactgtaaaacacaacatatccagtcactatggcggccgctaagttggcagcatcacccgacgcactttgcgccgaataaatacctgtgacggaagatcacttcgcagaataaataaatcctggtgtccctgttgataccgggaagccctgggccaacttttggcgaaaatgagacgttgatcggcacgtaagaggttccaactttcaccataatgaaataagatcactaccgggcgtattttttgagttatcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtctgtgatggcttccatgtcggcagaatgcttaatgaattacaacagtactgcgatgagtggcagggcggggcgtaaacgcgtggatccggcttactaaaagccagataacagtatgcgtatttgcgcgctgatttttgcggtataagaatatatactgatatgtatacccgaagtatgtcaaaaagaggtgtgctatgaagcagcgtattacagtgacagttgacagcgacagctatcagttgctcaaggcatatatgatgtcaatatctccggtctggtaagcacaaccatgcagaatgaagcccgtcgtctgcgtgccgaacgctggaaagcggaaaatcaggaagggatggctgaggtcgcccggtttattgaaatgaacggctcttttgctgacgagaacagggactggtgaaatgcagtttaaggtttacacctataaaagagagagccgttatcgtctgtttgtggatgtacagagtgatattattgacacgcccgggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatataaatgtcaggctcccttatacacagccagtctgcaggtcgaccatagtgactggatatgttgtgttttacagtattatgtagtctgttttttatgcaaaatctaatttaatatattgatatttatatcattttacgtttctcgttcagctttcttgtacaaagtggtgatggggatcctctagagtcgacctgcagtaatcgtacagggtagtacaaataaaaaaggcacgtcagatgacgtgccttttttcttgtgagcagtaagcttggctgttttggcggatgagagaagattttcagcctgatacagattaaatcagaacgcagaagcggtctgataaaacagaatttgcctggcggcagtagcgcggtggtcccacctgaccccatgccgaactcagaagtgaaacgccgtagcgccgatggtagtgtggggtctccccatgcgagagtagggaactgccaggcatcaaataaaacgaaaggctcagtcgaaagactgggcctttcgttttatctgttgtttgtcggtgaacgctctcctgagtaggacaaatccgccgggagcggatttgaacgttgcgaagcaacggcccggagggtggcgggcaggacgcccgccataaactgccaggcatcaaattaagcagaaggccatcctgacggatggcctttttgcgtttctacaaactctttttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctacagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcataattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgctatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagcagatcaattcgcgcgcgaaggcgaagcggcatgcatttacgttgacaccatcgaatggtgcaaaacctttcgcggtatggcatgatagcgcccggaagagagtcaattcagggtggtgaatgtgaaaccagtaacgttatacgatgtcgcagagtatgccggtgtctcttatcagaccgtttcccgcgtggtgaaccaggccagccacgtttctgcgaaaacgcgggaaaaagtggaagcggcgatggcggagctgaattacattcccaaccgcgtggcacaacaactggcgggcaaacagtcgttgctgattggcgttgccacctccagtctggccctgcacgcgccgtcgcaaattgtcgcggcgattaaatctcgcgccgatcaactgggtgccagcgtggtggtgtcgatggtagaacgaagcggcgtcgaagcctgtaaagcggcggtgcacaatcttctcgcgcaacgcgtcagtngggctgatcattaa

SEQ ID NO: 133 - DNA, 5957 bp, Artificial Sequence
  Description of Artificial Sequence: Synthetic pDEST5 polynucleotide
  gene (181)..(305): attR1
  gene (555)..(1214): CmR
  gene (1334)..(1418): inactivated ccdA
  gene (1556)..(1861): ccdB
  gene (1902)..(2026): attR2
  gene (2278)..(2733): f1 (f1 intergenic region)
  gene (2865)..(3722): ampR
  gene (5378)..(5538): ori
  gene (4756)..(5922): lacI
aggcaccccaggctttacactttatgcttccggctcgtatgttgtgtggaattgtgagcggataacaatttcacacaggaaacagctatgaccatgattacgccaagctctaatacgactcactatagggaaagctggtacgcctgcaggtaccggtccggaattcccgggtcgacgatcacaagtttgtacaaaaaagctgaacgagaaacgtaaaatgatataaatatcaatatattaaattagattttgcataaaaaacagactacataatactgtaaaacacaacatatccagtcactatggcggccgctaagttggcagcatcacccgacgcactttgcgccgaataaatacctgtgacggaagatcacttcgcagaataaataaatcctggtgtccctgttgataccgggaagccctgggccaacttttggcgaaaatgagacgttgatcggcacgtaagaggttccaactttcaccataatgaaataagatcactaccgggcgtattttttgagttatcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtctgtgatggcttccatgtcggcagaatgcttaatgaattacaacagtactgcgatgagtggcagggcggggcgtaaacgcgtggatccggcttactaaaagccagataacagtatgcgtatttgcgcgctgatttttgcggtataagaatatatactgatatgtatacccgaagtatgtcaaaaagaggtgtgctatgaagcagcgtattacagtgacagttgacagcgacagctatcagttgctcaaggcatatatgatgtcaatatctccggtctggtaagcacaaccatgcagaatgaagcccgtcgtctgcgtgccgaacgctggaaagcggaaaatcaggaagggatggctgaggtcgcccggtttattgaaatgaacggctcttttgctgacgagaacagggactggtgaaatgcagtttaaggtttacacctataaaagagagagccgttatcgtctgtttgtggatgtacagagtgatattattgacacgcccgggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatataaatgtcaggctcccttatacacagccagtctgcaggtcgaccatagtgactggatatgttgtgttttacagtattatgtagtctgttttttatgcaaaatctaatttaatatattgatatttatatcattttacgtttctcgttcagctttcttgtacaaagtggtgatcactagtcggcggccgctctagaggatccaagcttacgtacgcgtgcatgcgacgtcatagctcttctatagtgtcacctaaattcaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagagcttgcaattcgcgcgcgaaggcgaagcggcatttacgttgacaccatcgaatggcgcaaaacctttcgcggtatggcatgatagcgcccggaagagagtcaattcagggtggtgaatgtgaaaccagtaacgttatacgatgtcgcagagtatgccggtgtctcttatcagaccgtttcccgcgtggtgaaccaggccagccacgtttctgcgaaaacgcgggaaaaagtggaagcggcgatggcggagctgaattacattcccaaccgcgtggcacaacaactggcgggcaaacagtcgttgctgattggcgttgccacctccagtctggccctgcacgcgccgtcgcaaattgtcgcggcgattaaatctcgcgccgatcaactgggtgccagcgtggtggtgtcgatggtagaacgaagcggcgtcgaagcctgtaaagcggcggtgcacaatcttctcgcgcaacgggtcagtgggctgatcattaactatccgctggatgaccaggatgccattgctgtggaagctgcctgcactaatgttccggcgttatttcttgatgtctctgaccagacacccatcaacagtattattttctcccatgaagacggtacgcgactgggcgtggagcatctggtcgcattgggtcaccagcaaatcgcgctgttagcgggcccattaagttctgtctcggcgcgtctgcgtctggctggctggcataaatatctcactcgcaatcaaattcagccgatagcggaacgggaaggcgactggagtgccatgtccggttttcaacaaaccatgcaaatgctgaatgagggcatcgttcccactgcgatgctggttgccaacgatcagatggcgctgggcgcaatgcgcgccattaccgagtccgggctgcgcgttggtgcggatatctcggtagtgggatacgacgataccgaagacagctcatgttatatcccgccgtcaaccaccatcaaacaggattttcgcctgctggggcaaaccagcgtggaccgcttgctgcaactctctcagggccaggcggtgaagggcaatcagctgttgcccgtctcactggtgaaaagaaaaaccaccctggcgcccaatacgcaaaccgcctctccccgcgcgttggccgattcattaatgcagctggcacgacaggtttcccgactggaaagcgggcagtgagcgcaacgcaattaatgtgagttagctcactcatt

SEQ ID NO: 134 - DNA, 5957 bp, Artificial Sequence
  Description of Artificial Sequence: Synthetic pDEST6 polynucleotide
  gene (142)..(266): attR1
  gene (516)..(1175): CmR
  gene (1295)..(1379): inactivated ccdA
  gene (1517)..(1822): ccdB
  gene (1863)..(1987): attR2
  gene (2203)..(3369): lacI
  gene (4403)..(5260): ampR
  gene (5392)..(5847): f1 (f1 intergenic region)
taacgccagggttttcccagtcacgacgttgtaaaacgacggccagtgaattgaatttaggtgacactatagaagagctatgacgtcgcatgcacgcgtacgtaagcttggatcctctagagcggccgccgactagtgatcacaagtttgtacaaaaaagctgaacgagaaacgtaaaatgatataaatatcaatatattaaattagattttgcataaaaaacagactacataatactgtaaaacacaacatatccagtcactatggcggccgctaagttggcagcatcacccgacgcactttgcgccgaataaatacctgtgacggaagatcacttcgcagaataaataaatcctggtgtccctgttgataccgggaagccctgggccaacttttggcgaaaatgagacgttgatcggcacgtaagaggttccaactttcaccataatgaaataagatcactaccgggcgtattttttgagttatcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtctgtgatggcttccatgtcggcagaatgcttaatgaattacaacagtactgcgatgagtggcagggcggggcgtaaacgcgtggatccggcttactaaaagccagataacagtatgcgtatttgcgcgctgatttttgcggtataagaatatatactgatatgtatacccgaagtatgtcaaaaagaggtgtgctatgaagcagcgtattacagtgacagttgacagcgacagctatcagttgctcaaggcatatatgatgtcaatatctccggtctggtaagcacaaccatgcagaatgaagcccgtcgtctgcgtgccgaacgctggaaagcggaaaatcaggaagggatggctgaggtcgcccggtttattgaaatgaacggctcttttgctgacgagaacagggactggtgaaatgcagtttaaggtttacacctataaaagagagagccgttatcgtctgtttgtggatgtacagagtgatattattgacacgcccgggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatataaatgtcaggctcccttatacacagccagtctgcaggtcgaccatagtgactggatatgttgtgttttacagtattatgtagtctgttttttatgcaaaatctaatttaatatattgatatttatatcattttacgtttctcgttcagctttcttgtacaaagtggtgatcgtcgacccgggaattccggaccggtacctgcaggcgtaccagctttccctatagtgagtcgtattagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttgacggcgggatataacatgagctgtcttcggtatcgtcgtatcccactaccgagatatccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacccgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtcaacgtaaatgccgcttcgccttcgcgcgcgaattgcaagctctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgatcggtgcgggcctcttcgctattacgccagctggcgaaagggggatgtgctgcaaggcgattaagttggg

SEQ ID NO: 135 - DNA, 6025 bp, Artificial Sequence
  Description of Artificial Sequence: Synthetic pDEST7 polynucleotide
  gene (67)..(589): CMV promoter
  gene (782)..(906): attR1
  gene (1015)..(1674): CmR
  gene (1794)..(1878): inactivated ccdA
  gene (2016)..(2321): ccdB
  gene (2362)..(2486): attR2
  gene (2671)..(3033): small t & polyA
  gene (3227)..(3502): f1
  gene (3962)..(4822): ampR
  gene (5022)..(5661): ori
attatcatgacattaacctataaaaataggcgtagtacgaggccctttcactcattagatgcatgtcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccggactctagcctaggccgcggagcggataacaatttcacacaggaaacagctatgaccattaggcctttgcaaaaagctatttaggtgacactatagaaggtacgcctgcaggtaccggatcacaagtttgtacaaaaaagctgaacgagaaacgtaaaatgatataaatatcaatatattaaattagattttgcataaaaaacagactacataatactgtaaaacacaacatatccagtcactatggcggccgcattaggcaccccaggctttacactttatgcttccggctcgtataatgtgtggattttgagttaggatccgtcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtctgtgatggcttccatgtcggcagaatgcttaatgaattacaacagtactgcgatgagtggcagggcggggcgtaaacgcgtggatccggcttactaaaagccagataacagtatgcgtatttgcgcgctgatttttgcggtataagaatatatactgatatgtatacccgaagtatgtcaaaaagaggtgtgctatgaagcagcgtattacagtgacagttgacagcgacagctatcagttgctcaaggcatatatgatgtcaatatctccggtctggtaagcacaaccatgcagaatgaagcccgtcgtctgcgtgccgaacgctggaaagcggaaaatcaggaagggatggctgaggtcgcccggtttattgaaatgaacggctcttttgctgacgagaacagggactggtgaaatgcagtttaaggtttacacctataaaagagagagccgttatcgtctgtttgtggatgtacagagtgatattattgacacgcccgggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatataaatgtcaggctcccttatacacagccagtctgcaggtcgaccatagtgactggatatgttgtgttttacagtattatgtagtctgttttttatgcaaaatctaatttaatatattgatatttatatcattttacgtttctcgttcagctttcttgtacaaagtggtgatcgcgtgcatgcgacgtcatagctctctccctatagtgagtcgtattataagctaggcactggccgtcgttttacaacgtcgtgactgggaaaactgctagcttgggatctttgtgaaggaaccttacttctgtggtgtgacataattggacaaactacctacagagatttaaagctctaaggtaaatataaaatttttaagtgtataatgtgttaaactagctgcatatgcttgctgcttgagagttttgcttactgagtatgatttatgaaaatattatacacaggagctagtgattctaattgtttgtgtattttagattcacagtcccaaggctcatttcaggcccctcagtcctcacagtctgttcatgatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggatcgatcctgcattaatgaatcggccaacgcgcggggagaggcggtttgcgtattggctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcaggtggcacttttcggggaaatgtgcgcggaacccctatttgtttatttttctaaatacattcaaatatgtatccgctcatgccaggtcttggactggtgagaacggcttgctcggcagcttcgatgtgtgctggagggagaataaaggtctaagatgtgcgatagagggaagtcgcattgaattatgtgctgtgtagggatcgctggtatcaaatatgtgtgcccacccctggcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgccataacttcgtataatgtatgctatacgaagttatggcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagagcttgcaattcgcgcgtttttcaatattattgaagcatttatcagggttattgtctcatgagcggatacatatttgaatgtatttagaaaaataaacaaataggggttccgcgcacatttccccgaaaagtgccacctgacgtctaagaaaccatt

SEQ ID NO: 136 - DNA, 6526 bp, Artificial Sequence
  Description of Artificial Sequence: Synthetic pDEST8 polynucleotide
  gene (23)..(152): Ppo1h
  gene (160)..(284): attR1
  gene (534)..(1193): CmR
  gene (1313)..(1397): inactivated ccdA
  gene (1535)..(1840): ccdB
  gene (1881)..(2005): attR2
  gene (2766)..(3146): f1
  gene (3240)..(4090): ampR
  gene (4289)..(4869): ori
  gene (5564)..(6496): genR
cgtatactccggaatattaatagatcatggagataattaaaatgataaccatctcgcaaataaataagtattttactgttttcgtaacagttttgtaataaaaaaacctataaatattccggattattcataccgtcccaccatcgggcgcggatcatcacaagtttgtacaaaaaagctgaacgagaaacgtaaaatgatataaatatcaatatattaaattagattttgcataaaaaacagactacataatactgtaaaacacaacatatccagtcactatggcggccgctaagttggcagcatcacccgacgcactttgcgccgaataaatacctgtgacggaagatcacttcgcagaataaataaatcctggtgtccctgttgataccgggaagccctgggccaacttttggcgaaaatgagacgttgatcggcacgtaagaggttccaactttcaccataatgaaataagatcactaccgggcgtattttttgagttatcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtctgtgatggcttccatgtcggcagaatgcttaatgaattacaacagtactgcgatgagtggcagggcggggcgtaaacgcgtggatccggcttactaaaagccagataacagtatgcgtatttgcgcgctgatttttgcggtataagaatatatactgatatgtatacccgaagtatgtcaaaaagaggtgtgctatgaagcagcgtattacagtgacagttgacagcgacagctatcagttgctcaaggcatatatgatgtcaatatctccggtctggtaagcacaaccatgcagaatgaagcccgtcgtctgcgtgccgaacgctggaaagcggaaaatcaggaagggatggctgaggtcgcccggtttattgaaatgaacggctcttttgctgacgagaacagggactggtgaaatgcagtttaaggtttacacctataaaagagagagccgttatcgtctgtttgtggatgtacagagtgatattattgacacgcccgggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatataaatgtcaggctcccttatacacagccagtctgcaggtcgaccatagtgactggatatgttgtgttttacagtattatgtagtctgttttttatgcaaaatctaatttaatatattgatatttatatcattttacgtttctcgttcagctttcttgtacaaagtggtgatagcttgtcgagaagtactagaggatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggatctgatcactgcttgagcctaggagatccgaaccagataagtgaaatctagttccaaactattttgtcatttttaattttcgtattagcttacgacgctacacccagttcccatctattttgtcactcttccctaaataatccttaaaaactccatttccacccctcccagttcccaactattttgtccgcccacagcggggcatttttcttcctgttatgtttttaatcaaacatcctgccaactccatgtgacaaaccgtcatcttcggctactttttctctgtcacagaatgaaaatttttctgtcatctcttcgttattaatgtttgtaattgactgaatatcaacgcttatttgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcagaccagccgcgtaacctggcaaaatcggttacggttgagtaataaatggatgccctgcgtaagcgggtgtgggcggacaataaagtcttaaactgaacaaaatagatctaaactatgacaataaagtcttaaactagacagaatagttgtaaactgaaatcagtccagttatgctgtgaaaaagcatactggacttttgttatggctaaagcaaactcttcattttctgaagtgcaaattgcccgtcgtattaaagaggggcgtggccaagggcatggtaaagactatattcgcggcgttgtgacaatttaccgaacaactccgcggccgggaagccgatctcggcttgaacgaattgttaggtggcggtacttgggtcgatatcaaagtgcatcacttcttcccgtatgcccaactttgtatagagagccactgcgggatcgtcaccgtaatctgcttgcacgtagatcacataagcaccaagcgcgttggcctcatgcttgaggagattgatgagcgcggtggcaatgccctgcctccggtgctcgccggagactgcgagatcatagatatagatctcactacgcggctgctcaaacctgggcagaacgtaagccgcgagagcgccaacaaccgcttcttggtcgaaggcagcaagcgcgatgaatgtcttactacggagcaagttcccgaggtaatcggagtccggctgatgttgggagtaggtggctacgtctccgaactcacgaccgaaaagatcaagagcagcccgcatggatttgacttggtcagggccgagcctacatgtgcgaatgatgcccatacttgagccacctaactttgttttagggcgactgccctgctgcgtaacatcgttgctgctgcgtaacatcgttgctgctccataacatcaaacatcgacccacggcgtaacgcgcttgctgcttggatgcccgaggcatagactgtacaaaaaaacagtcataacaagccatgaaaaccgccactgcgccgttaccaccgctgcgttcggtcaaggttctggaccagttgcgtgagcgcatacgctacttgcattacagtttacgaaccgaacaggcttatgtcaactgggttcgtgccttcatccgtttccacggtgtgcgtcacccggcaaccttgggcagcagcgaagtcgaggcatttctgtcctggctggcgaacgagcgcaaggtttcggtctccacgcatcgtcaggcattggcggccttgctgttcttctacggcaaggtgctgtgcacggatctgccctggcttcaggagatcggaagacctcggccgtcgcggcgcttgccggtggtgctgaccccggatgaagtggttcgcatcctcggttttctggaaggcgagcatcgtttgttcgcccaggactctagctatagttctagtggttggcta

SEQ ID NO: 137 - DNA, 12464 bp, Artificial Sequence
  Description of Artificial Sequence: Synthetic pDEST9 polynucleotide
  gene (232)..(355): attR1
  gene (605)..(1264): CmR
  gene (1384)..(1468): inactivated ccdA
  gene (1606)..(1911): ccdB
  gene (1952)..(2078): attR2
  gene (2532)..(2782): ori
  gene (3482)..(4282): ampR
  gene (5232)..(5365): SP6 promoter
  gene (5365)..(6965): nsP1:non-structural protein 1
  gene (6965)..(9265): nsP2:non-structural protein 2
  gene (9265)..(10865): nsP3:non-structural protein 3
  gene (161)..(10865): nsP4:non-structural protein 4
agcaagtggttccggacaggcttgggggccgaactggaggtggcactaacatctaggtatgaggtagagggctgcaaaagtatcctcatagccatggccaccttggcgagggacattaaggcgtttaagaaattgagaggacctgttatacacctctacggcggtcctagattggtgcgttaatacacagaattctgattggatcccggtccgaagcgcgctttcccatcacaagtttgtacaaaaaagctgaacgagaaacgtaaaatgatataaatatcaatatattaaattagattttgcataaaaaacagactacataatactgtaaaacacaacatatccagtcactatggcggccgctaagttggcagcatcacccgacgcactttgcgccgaataaatacctgtgacggaagatcacttcgcagaataaataaatcctggtgtccctgttgataccgggaagccctgggccaacttttggcgaaaatgagacgttgatcggcacgtaagaggttccaactttcaccataatgaaataagatcactaccgggcgtattttttgagttatcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtctgtgatggcttccatgtcggcagaatgcttaatgaattacaacagtactgcgatgagtggcagggcggggcgtaaagatctggatccggcttactaaaagccagataacagtatgcgtatttgcgcgctgatttttgcggtataagaatatatactgatatgtatacccgaagtatgtcaaaaagaggtgtgctatgaagcagcgtattacagtgacagttgacagcgacagctatcagttgctcaaggcatatatgatgtcaatatctccggtctggtaagcacaaccatgcagaatgaagcccgtcgtctgcgtgccgaacgctggaaagcggaaaatcaggaagggatggctgaggtcgcccggtttattgaaatgaacggctcttttgctgacgagaacagggactggtgaaatgcagtttaaggtttacacctataaaagagagagccgttatcgtctgtttgtggatgtacagagtgatattattgacacgcccgggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatataaatgtcaggctcccttatacacagccagtctgcaggtcgaccatagtgactggatatgttgtgttttacagtattatgtagtctgttttttatgcaaaagtgctaatttaatatattgatatttatatcattttacgtttctcgttcagctttcttgtacaaagtggtgatgggaactcgagttcactagtcgatcccgcggccgctttcgaacctaggcaagcatgcgggcccagtgggtaattaattgaattacatccctacgcaaacgttttacggccgccggtggcgcccgcgcccggcggcccgtccttggccgttgcaggccactccggtggctcccgtcgtccccgacttccaggcccagcagatgcagcaactcatcagcgccgtaaatgcgctgacaatgagacagaacgcaattgctcctgctaggagcttaattcgacgaataattggatttttattttattttgcaattggtttttaatatttccaaaaaaaaaaaaaaaaaaaaaaaaaaaaaaaaaaaaaaaaaaaaaaaaaaaaaaaaaaaaaaaaaaaaaactagaaatcgcgatttctagtctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcgcgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttctgtctaagcggatgccgggagcagacaagcccgtcagggcgcgtcagcgggtgttggcgggtgtcggggctggcttaactatgcggcatcagagcagattgtactgagagtgcaccatatcgacgctctcccttatgcgactcctgcattaggaagcagcccagtactaggttgaggccgttgagcaccgccgccgcaaggaatggtgcatgcaaggagatggcgcccaacagtcccccggccacggggcctgccaccatacccacgccgaaacaagcgctcatgagcccgaagtggcgagcccgatcttccccatcggtgatgtcggcgatataggcgccagcaaccgcacctgtggcgccggtgatgccggccacgatgcgtccggcgtagaggatctggctagcgatgaccctgctgattggttcgctgaccatttccggggtgcggaacggcgttaccagaaactcagaaggttcgtccaaccaaaccgactctgacggcagtttacgagagagatgatagggtctgcttcagtaagccagatgctacacaattaggcttgtacatattgtcgttagaacgcggctacaattaatacataaccttatgtatcatacacatacgatttaggtgacactatagatggcggatgtgtgacatacacgacgccaaaagattttgttccagctcctgccacctccgctacgcgagagattaaccacccacgatggccgccaaagtgcatgttgatattgaggctgacagcccattcatcaagtctttgcagaaggcatttccgtcgttcgaggtggagtcattgcaggtcacaccaaatgaccatgcaaatgccagagcattttcgcacctggctaccaaattgatcgagcaggagactgacaaagacacactcatcttggatatcggcagtgcgccttccaggagaatgatgtctacgcacaaataccactgcgtatgccctatgcgcagcgcagaagaccccgaaaggctcgatagctacgcaaagaaactggcagcggcctccgggaaggtgctggatagagagatcgcaggaaaaatcaccgacctgcagaccgtcatggctacgccagacgctgaatctcctaccttttgcctgcatacagacgtcacgtgtcgtacggcagccgaagtggccgtataccaggacgtgtatgctgtacatgcaccaacatcgctgtaccatcaggcgatgaaaggtgtcagaacggcgtattggattgggtttgacaccaccccgtttatgtttgacgcgctagcaggcgcgtatccaacctacgccacaaactgggccgacgagcaggtgttacaggccaggaacataggactgtgtgcagcatccttgactgagggaagactcggcaaactgtccattctccgcaagaagcaattgaaaccttgcgacacagtcatgttctcggtaggatctacattgtacactgagagcagaaagctactgaggagctggcacttaccctccgtattccacctgaaaggtaaacaatcctttacctgtaggtgcgataccatcgtatcatgtgaagggtacgtagttaagaaaatcactatgtgccccggcctgtacggtaaaacggtagggtacgccgtgacgtatcacgcggagggattcctagtgtgcaagaccacagacactgtcaaaggagaaagagtctcattccctgtatgcacctacgtcccctcaaccatctgtgatcaaatgactggcatactagcgaccgacgtcacaccggaggacgcacagaagttgttagtgggattgaatcagaggatagttgtgaacggaagaacacagcgaaacactaacacgatgaagaactatctgcttccgattgtggccgtcgcatttagcaagtgggcgagggaatacaaggcagaccttgatgatgaaaaacctctgggtgtccgagagaggtcacttacttgctgctgcttgtgggcatttaaaacgaggaagatgcacaccatgtacaagaaaccagacacccagacaatagtgaaggtgccttcagagtttaactcgttcgtcatcccgagcctatggtctacaggcctcgcaatcccagtcagatcacgcattaagatgcttttggccaagaagaccaagcgagagttaatacctgttctcgacgcgtcgtcagccagggatgctgaacaagaggagaaggagaggttggaggccgagctgactagagaagccttaccacccctcgtccccatcgcgccggcggagacgggagtcgtcgacgtcgacgttgaagaactagagtatcacgcaggtgcaggggtcgtggaaacacctcgcagcgcgttgaaagtcaccgcacagccgaacgacgtactactaggaaattacgtagttctgtccccgcagaccgtgctcaagagctccaagttggcccccgtgcaccctctagcagagcaggtgaaaataataacacataacgggagggccggcggttaccaggtcgacggatatgacggcagggtcctactaccatgtggatcggccattccggtccctgagtttcaggctttgagcgagagcgccactatggtgtacaacgaaagggagttcgtcaacaggaaactataccatattgccgttcacggaccctcgctgaacaccgacgaggagaactacgagaaagtcagagctgaaagaactgacgccgagtacgtgttcgacgtagataaaaaatgctgcgtcaagagagaggaagcgtcgggtttggtgttggtgggagagctaaccaaccccccgttccatgaattcgcctacgaagggctgaagatcaggccgtcggcaccatataagactacagtagtaggagtctttggggttccgggatcaggcaagtctgctattattaagagcctcgtgaccaaacacgatctggtcaccagcggcaagaaggagaactgccaggaaatagttaacgacgtgaagaagcaccgcgggaaggggacaagtagggaaaacagtgactccatcctgctaaacgggtgtcgtcgtgccgtggacatcctatatgtggacgaggctttcgcttgccattccggtactctgctggccctaattgctcttgttaaacctcggagcaaagtggtgttatgcggagaccccaagcaatgcggattcttcaatatgatgcagcttaaggtgaacttcaaccacaacatctgcactgaagtatgtcataaaagtatatccagacgttgcacgcgtccagtcacggccatcgtgtctacgttgcactacggaggcaagatgcgcacgaccaacccgtgcaacaaacccataatcatagacaccacaggacagaccaagcccaagccaggagacatcgtgttaacatgcttccgaggctgggcaaagcagctgcagttggactaccgtggacacgaagtcatgacagcagcagcatctcagggcctcacccgcaaaggggtatacgccgtaaggcagaaggtgaatgaaaatcccttgtatgcccctgcgtcggagcacgtgaatgtactgctgacgcgcactgaggataggctggtgtggaaaacgctggccggcgatccctggattaaggtcctatcaaacattccacagggtaactttacggccacattggaagaatggcaagaagaacacgacaaaataatgaaggtgattgaaggaccggctgcgcctgtggacgcgttccagaacaaagcgaacgtgtgttgggcgaaaagcctggtgcctgtcctggacactgccggaatcagattgacagcagaggagtggagcaccataattacagcatttaaggaggacagagcttactctccagtggtggccttgaatgaaatttgcaccaagtactatggagttgacctggacagtggcctgttttctgccccgaaggtgtccctgtattacgagaacaaccactgggataacagacctggtggaaggatgtatggattcaatgccgcaacagctgccaggctggaagctagacataccttcctgaaggggcagtggcatacgggcaagcaggcagttatcgcagaaagaaaaatccaaccgctttctgtgctggacaatgtaattcctatcaaccgcaggctgccgcacgccctggtggctgagtacaagacggttaaaggcagtagggttgagtggctggtcaataaagtaagagggtaccacgtcctgctggtgagtgagtacaacctggctttgcctcgacgcagggtcacttggttgtcaccgctgaatgtcacaggcgccgataggtgctacgacctaagtttaggactgccggctgacgccggcaggttcgacttggtctttgtgaacattcacacggaattcagaatccaccactaccagcagtgtgtcgaccacgccatgaagctgcagatgcttgggggagatgcgctacgactgctaaaacccggcggcatcttgatgagagcttacggatacgccgataaaatcagcgaagccgttgtttcctccttaagcagaaagttctcgtctgcaagagtgttgcgcccggattgtgtcaccagcaatacagaagtgttcttgctgttctccaactttgacaacggaaagagaccctctacgctacaccagatgaataccaagctgagtgccgtgtatgccggagaagccatgcacacggccgggtgtgcaccatcctacagagttaagagagcagacatagccacgtgcacagaagcggctgtggttaacgcagctaacgcccgtggaactgtaggggatggcgtatgcagggccgtggcgaagaaatggccgtcagcctttaagggagcagcaacaccagtgggcacaattaaaacagtcatgtgcggctcgtaccccgtcatccacgctgtagcgcctaatttctctgccacgactgaagcggaaggggaccgcgaattggccgctgtctaccgggcagtggccgccgaagtaaacagactgtcactgagcagcgtagccatcccgctgctgtccacaggagtgttcagcggcggaagagataggctgcagcaatccctcaaccatctattcacagcaatggacgccacggacgctgacgtgaccatctactgcagagacaaaagttgggagaagaaaatccaggaagccattgacatgaggacggctgtggagttgctcaatgatgacgtggagctgaccacagacttggtgagagtgcacccggacagcagcctggtgggtcgtaagggctacagtaccactgacgggtcgctgtactcgtactttgaaggtacgaaattcaaccaggctgctattgatatggcagagatactgacgttgtggcccagactgcaagaggcaaacgaacagatatgcctatacgcgctgggcgaaacaatggacaacatcagatccaaatgtccggtgaacgattccgattcatcaacacctcccaggacagtgccctgcctgtgccgctacgcaatgacagcagaacggatcgcccgccttaggtcacaccaagttaaaagcatggtggtttgctcatcttttcccctcccgaaataccatgtagatggggtgcagaaggtaaagtgcgagaaggttctcctgttcgacccgacggtaccttcagtggttagtccgcggaagtatgccgcatctacgacggaccactcagatcggtcgttacgagggtttgacttggactggaccaccgactcgtcttccactgccagcgataccatgtcgctacccagtttgcagtcgtgtgacatcgactcgatctacgagccaatggctcccatagtagtgacggctgacgtacaccctgaacccgcaggcatcgcggacctggcggcagatgtgcaccctgaacccgcagaccatgtggacctggagaacccgattcctccaccgcgcccgaagagagctgcataccttgcctcccgcgcggcggagcgaccggtgccggcgccgagaaagccgacgcctgccccaaggactgcgtttaggaacaagctgcctttgacgttcggcgactttgacgagcacgaggtcgatgcgttggcctccgggattactttcggagacttcgacgacgtcctgcgactaggccgcgcgggtgcatatattttctcctcggacactggcagcggacatttacaacaaaaatccgttaggcagcacaatctccagtgcgcacaactggatgcggtccaggaggagaaaatgtacccgccaaaattggatactgagagggagaagctgttgctgctgaaaatgcagatgcacccatcggaggctaataagagtcgataccagtctcgcaaagtggagaacatgaaagccacggtggtggacaggctcacatcgggggccagattgtacacgggagcggacgtaggccgcataccaacatacgcggttcggtacccccgccccgtgtactcccctaccgtgatcgaaagattctcaagccccgatgtagcaatcgcagcgtgcaacgaatacctatccagaaattacccaacagtggcgtcgtaccagataacagatgaatacgacgcatacttggacatggttgacgggtcggatagttgcttggacagagcgacattctgcccggcgaagctccggtgctacccgaaacatcatgcgtaccaccagccgactgtacgcagtgccgtcccgtcaccctttcagaacacactacagaacgtgctagcggctgccaccaagagaaactgcaacgtcacgcaaatgcgagaactacccaccatggactcggcagtgttcaacgtggagtgcttcaagcgctatgcctgctccggagaatattgggaagaatatgctaaacaacctatccggataaccactgagaacatcactacctatgtgaccaaattgaaaggcccgaaagctgctgccttgttcgctaagacccacaacttggttccgctgcaggaggttcccatggacagattcacggtcgacatgaaacgagatgtcaaagtcactccagggacgaaacacacagaggaaagacccaaagtccaggtaattcaagcagcggagccattggcgaccgcttacctgtgcggcatccacagggaattagtaaggagactaaatgctgtgttacgccctaacgtgcacacattgtttgatatgtcggccgaagactttgacgcgatcatcgcctctcacttccacccaggagacccggttctagagacggacattgcatcattcgacaaaagccaggacgactccttggctcttacaggtttaatgatcctcgaagatctaggggtggatcagtacctgctggacttgatcgaggcagcctttggggaaatatccagctgtcacctaccaactggcacgcgcttcaagttcggagctatgatgaaatcgggcatgtttctgactttgtttattaacactgttttgaacatcaccatagcaagcagggtactggagcagagactcactgactccgcctgtgcggccttcatcggcgacgacaacatcgttcacggagtgatctccgacaagctgatggcggagaggtgcgcgtcgtgggtcaacatggaggtgaagatcattgacgctgtcatgggcgaaaaacccccatatttttgtgggggattcatagtttttgacagcgtcacacagaccgcctgccgtgtttcagacccacttaagcgcctgttcaagttgggtaagccgctaacagctgaagacaagcaggacgaagacaggcgacgagcactgagtgacgaggtt

SEQ ID NO: 138 - DNA, 6708 bp, Artificial Sequence
  Description of Artificial Sequence: Synthetic pDEST10 polynucleotide
  gene (23)..(152): Ppo1h
  gene (337)..(461): attR1
  gene (711)..(1370): CmR
  gene (1490)..(1574): inactivated ccdA
  gene (1712)..(2017): ccdB
  gene (2058)..(2182): attR2
  gene (3394)..(4369): ampR
  gene (4510)..(5164): ori
  gene (62)..(5658): genR
ccccggatgaagtggttcgcatcctcggttttctggaaggcgagcatcgtttgttcgcccaggactctagctatagttctagtggttggctacgtatactccggaatattaatagatcatggagataattaaaatgataaccatctcgcaaataaataagtattttactgttttcgtaacagttttgtaataaaaaaacctataaatattccggattattcataccgtcccaccatcgggcgcggatctcggtccgaaaccatgtcgtactaccatcaccatcaccatcacgattacgatatcccaacgaccgaaaacctgtattttcagggcatcacaagtttgtacaaaaaagctgaacgagaaacgtaaaatgatataaatatcaatatattaaattagattttgcataaaaaacagactacataatactgtaaaacacaacatatccagtcactatggcggccgctaagttggcagcatcacccgacgcactttgcgccgaataaatacctgtgacggaagatcacttcgcagaataaataaatcctggtgtccctgttgataccgggaagccctgggccaacttttggcgaaaatgagacgttgatcggcacgtaagaggttccaactttcaccataatgaaataagatcactaccgggcgtattttttgagttatcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtctgtgatggcttccatgtcggcagaatgcttaatgaattacaacagtactgcgatgagtggcagggcggggcgtaaacgcgtggatccggcttactaaaagccagataacagtatgcgtatttgcgcgctgatttttgcggtataagaatatatactgatatgtatacccgaagtatgtcaaaaagaggtgtgctatgaagcagcgtattacagtgacagttgacagcgacagctatcagttgctcaaggcatatatgatgtcaatatctccggtctggtaagcacaaccatgcagaatgaagcccgtcgtctgcgtgccgaacgctggaaagcggaaaatcaggaagggatggctgaggtcgcccggtttattgaaatgaacggctcttttgctgacgagaacagggactggtgaaatgcagtttaaggtttacacctataaaagagagagccgttatcgtctgtttgtggatgtacagagtgatattattgacacgcccgggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatataaatgtcaggctcccttatacacagccagtctgcaggtcgaccatagtgactggatatgttgtgttttacagtattatgtagtctgttttttatgcaaaatctaatttaatatattgatatttatatcattttacgtttctcgttcagctttcttgtacaaagtggtgatgccatggatccggaattcaaaggcctacgtcgacgagctcaactagtgcggccgctttcgaatctagagcctgcagtctcgaggcatgcggtaccaagcttgtcgagaagtactagaggatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggatctgatcactgcttgagcctaggagatccgaaccagataagtgaaatctagttccaaactattttgtcatttttaattttcgtattagcttacgacgctacacccagttcccatctattttgtcactcttccctaaataatccttaaaaactccatttccacccctcccagttcccaactattttgtccgcccacagcggggcatttttcttcctgttatgtttttaatcaaacatcctgccaactccatgtgacaaaccgtcatcttcggctactttttctctgtcacagaatgaaaatttttctgtcatctcttcgttattaatgtttgtaattgactgaatatcaacgcttatttgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcagaccagccgcgtaacctggcaaaatcggttacggttgagtaataaatggatgccctgcgtaagcgggtgtgggcggacaataaagtcttaaactgaacaaaatagatctaaactatgacaataaagtcttaaactagacagaatagttgtaaactgaaatcagtccagttatgctgtgaaaaagcatactggacttttgttatggctaaagcaaactcttcattttctgaagtgcaaattgcccgtcgtattaaagaggggcgtggccaagggcatggtaaagactatattcgcggcgttgtgacaatttaccgaacaactccgcggccgggaagccgatctcggcttgaacgaattgttaggtggcggtacttgggtcgatatcaaagtgcatcacttcttcccgtatgcccaactttgtatagagagccactgcgggatcgtcaccgtaatctgcttgcacgtagatcacataagcaccaagcgcgttggcctcatgcttgaggagattgatgagcgcggtggcaatgccctgcctccggtgctcgccggagactgcgagatcatagatatagatctcactacgcggctgctcaaacctgggcagaacgtaagccgcgagagcgccaacaaccgcttcttggtcgaaggcagcaagcgcgatgaatgtcttactacggagcaagttcccgaggtaatcggagtccggctgatgttgggagtaggtggctacgtctccgaactcacgaccgaaaagatcaagagcagcccgcatggatttgacttggtcagggccgagcctacatgtgcgaatgatgcccatacttgagccacctaactttgttttagggcgactgccctgctgcgtaacatcgttgctgctgcgtaacatcgttgctgctccataacatcaaacatcgacccacggcgtaacgcgcttgctgcttggatgcccgaggcatagactgtacaaaaaaacagtcataacaagccatgaaaaccgccactgcgccgttaccaccgctgcgttcggtcaaggttctggaccagttgcgtgagcgcatacgctacttgcattacagtttacgaaccgaacaggcttatgtcaactgggttcgtgccttcatccgtttccacggtgtgcgtcacccggcaaccttgggcagcagcgaagtcgaggcatttctgtcctggctggcgaacgagcgcaaggtttcggtctccacgcatcgtcaggcattggcggccttgctgttcttctacggcaaggtgctgtgcacggatctgccctggcttcaggagatcggaagacctcggccgtcgcggcgcttgccggtggtgctga

SEQ ID NO: 139 - DNA, 7026 bp, Artificial Sequence
  Description of Artificial Sequence: Synthetic pDEST11 polynucleotide
  pDEST11
  gene (4)..(479): Tetp ((tet operator) 7 and min hCMV promoter)
  gene (514)..(638): attR1
  gene (888)..(1547): CmR
  gene (1667)..(1751): inactivated ccdA
  gene (1889)..(2194): ccdB
  gene (2235)..(2359): attR2
  gene (2402)..(4132): polyA
  gene (4347)..(4803): f1 ori
  gene (4940)..(5797): ampR
cgagtttaccactccctatcagtgatagagaaaagtgaaagtcgagtttaccactccctatcagtgatagagaaaagtgaaagtcgagtttaccactccctatcagtgatagagaaaagtgaaagtcgagtttaccactccctatcagtgatagagaaaagtgaaagtcgagtttaccactccctatcagtgatagagaaaagtgaaagtcgagtttaccactccctatcagtgatagagaaaagtgaaagtcgagtttaccactccctatcagtgatagagaaaagtgaaagtcgagctcggtacccgggtcgagtaggcgtgtacggtgggaggcctatataagcagagctcgtttagtgaaccgtcagatcgcctggagacgccatccacgctgttttgacctccatagaagacaccgggaccgatccagcctccgcggccccgaattcgagctcggtacccggggatcctctagagtcgaggtcgacggtatcgataagcttgatatcaacaagtttgtacaaaaaagctgaacgagaaacgtaaaatgatataaatatcaatatattaaattagattttgcataaaaaacagactacataatactgtaaaacacaacatatccagtcactatggcggccgctaagttggcagcatcacccgacgcactttgcgccgaataaatacctgtgacggaagatcacttcgcagaataaataaatcctggtgtccctgttgataccgggaagccctgggccaacttttggcgaaaatgagacgttgatcggcacgtaagaggttccaactttcaccataatgaaataagatcactaccgggcgtattttttgagttatcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtctgtgatggcttccatgtcggcagaatgcttaatgaattacaacagtactgcgatgagtggcagggcggggcgtaaagatctggatccggcttactaaaagccagataacagtatgcgtatttgcgcgctgatttttgcggtataagaatatatactgatatgtatacccgaagtatgtcaaaaagaggtgtgctatgaagcagcgtattacagtgacagttgacagcgacagctatcagttgctcaaggcatatatgatgtcaatatctccggtctggtaagcacaaccatgcagaatgaagcccgtcgtctgcgtgccgaacgctggaaagcggaaaatcaggaagggatggctgaggtcgcccggtttattgaaatgaacggctcttttgctgacgagaacagggactggtgaaatgcagtttaaggtttacacctataaaagagagagccgttatcgtctgtttgtggatgtacagagtgatattattgacacgcccgggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatataaatgtcaggctcccttatacacagccagtctgcaggtcgaccatagtgactggatatgttgtgttttacagtattatgtagtctgttttttatgcaaaatctaatttaatatattgatatttatatcattttacgtttctcgttcagctttcttgtacaaagtggttgatatcgaattcctgcagcccgggggatccactagttctagagcactgcgatgagtggcagggcggggcgtaatttttttaaggcagttattggtgcccttaaacgcctggtgctacgcctgaataagtgataataagcggatgaatggcagaaattcgccggatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactcctccaaaaaagaagagaaaggtagaagaccccaaggactttccttcagaattgctaagttttttgagtcatgctgtgtttagtaatagaactcttgcttgctttgctatttacaccacaaaggaaaaagctgcactgctatacaagaaaattatggaaaaatattctgtaacctttataagtaggcataacagttataatcataacatactgttttttcttactccacacaggcatagagtgtctgctattaataactatgctcaaaaattgtgtacctttagctttttaatttgtaaaggggttaataaggaatatttgatgtatagtgccttgactagagatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggatccccaggaagctcctctgtgtcctcataaaccctaacctcctctacttgagaggacattccaatcataggctgcccatccaccctctgtgtcctcctgttaattaggtcacttaacaaaaaggaaattgggtaggggtttttcacagaccgctttctaagggtaattttaaaatatctgggaagtcccttccactgctgtgttccagaagtgttggtaaacagcccacaaatgtcaacagcagaaacatacaagctgtcagctttgcacaagggcccaacaccctgctcatcaagaagcactgtggttgctgtgttagtaatgtgcaaaacaggaggcacattttccccacctgtgtaggttccaaaatatctagtgttttcatttttacttggatcaggaacccagcactccactggataagcattatccttatccaaaacagccttgtggtcagtgttcatctgctgactgtcaactgtagcattttttggggttacagtttgagcaggatatttggtcctgtagtttgctaacacaccctgcagctccaaaggttccccaccaacagcaaaaaaatgaaaatttgacccttgaatgggttttccagcaccattttcatgagttttttgtgtccctgaatgcaagtttaacatagcagttaccccaataacctcagttttaacagtaacagcttcccacatcaaaatatttccacaggttaagtcctcatttaaattaggcaaaggaattgctctagagcggccgccaccgcggtggagctccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctgggtaccgggccccccct

SEQ ID NO: 140 - DNA, 7278 bp, Artificial Sequence
  Description of Artificial Sequence: Synthetic pDEST12.2 polynucleotide
  gene (86)..(136): ori
  gene (220)..(742): CMV promoter
  gene (935)..(1059): attR1
  gene (1168)..(1827): CmR
  gene (1947)..(2031): inactivated ccdA
  gene (2169)..(2474): ccdB
  gene (2515)..(2639): attR2
  gene (2824)..(3186): small t & polyA
  gene (3310)..(3378): lac
  gene (4363)..(5157): neo
  gene (5680)..(6540): neo
ggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagctcgcgaatgcatgtcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccggactctagcctaggccgcgggacggataacaatttcacacaggaaacagctatgaccattaggcctttgcaaaaagctatttaggtgacactatagaaggtacgcctgcaggtaccggatcacaagtttgtacaaaaaagctgaacgagaaacgtaaaatgatataaatatcaatatattaaattagattttgcataaaaaacagactacataatactgtaaaacacaacatatccagtcactatggcggccgcattaggcaccccaggctttacactttatgcttccggctcgtataatgtgtggattttgagttaggatccgtcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtctgtgatggcttccatgtcggcagaatgcttaatgaattacaacagtactgcgatgagtggcagggcggggcgtaaacgcgtggatccggcttactaaaagccagataacagtatgcgtatttgcgcgctgatttttgcggtataagaatatatactgatatgtatacccgaagtatgtcaaaaagaggtgtgctatgaagcagcgtattacagtgacagttgacagcgacagctatcagttgctcaaggcatatatgatgtcaatatctccggtctggtaagcacaaccatgcagaatgaagcccgtcgtctgcgtgccgaacgctggaaagcggaaaatcaggaagggatggctgaggtcgcccggtttattgaaatgaacggctcttttgctgacgagaacagggactggtgaaatgcagtttaaggtttacacctataaaagagagagccgttatcgtctgtttgtggatgtacagagtgatattattgacacgcccgggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatataaatgtcaggctcccttatacacagccagtctgcaggtcgaccatagtgactggatatgttgtgttttacagtattatgtagtctgttttttatgcaaaatctaatttaatatattgatatttatatcattttacgtttctcgttcagctttcttgtacaaagtggtgatcgcgtgcatgcgacgtcatagctctctccctatagtgagtcgtattataagctaggcactggccgtcgttttacaacgtcgtgactgggaaaactgctagcttgggatctttgtgaaggaaccttacttctgtggtgtgacataattggacaaactacctacagagatttaaagctctaaggtaaatataaaatttttaagtgtataatgtgttaaactagctgcatatgcttgctgcttgagagttttgcttactgagtatgatttatgaaaatattatacacaggagctagtgattctaattgtttgtgtattttagattcacagtcccaaggctcatttcaggcccctcagtcctcacagtctgttcatgatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggatcgatcctgcattaatgaatcggccaacgcgcggggagaggcggtttgcgtattggctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaatatttaacgcgaattttaacaaaatattaacgtttacaatttcgcctgatgcggtattttctccttacgcatctgtgcggtatttcacaccgcatacgcggatctgcgcagcaccatggcctgaaataacctctgaaagaggaacttggttaggtaccttctgaggcggaaagaaccagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagcttgattcttctgacacaacagtctcgaacttaaggctagagccaccatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgatggccgcaataaaatatctttattttcattacatctgtgtgttggttttttgtgtgaatcgatagcgataaggatccgcgtatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtca

SEQ ID NO: 141 - DNA, 5848 bp, Artificial Sequence
  Description of Artificial Sequence: Synthetic pDEST13 polynucleotide
  gene (599)..(1458): ampR
  gene (3998)..(4123): attR1
  gene (4372)..(5031): CmR
  gene (5151)..(5235): inactivated ccdA
  gene (5373)..(5678): ccdB
  gene (5719)..(5843): attR2
ttcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttggctgcaggtgatgattatcagccagcagagattaaggaaaacagacaggtttattgagcgcttatctttccctttatttttgctgcggtaagtcgcataaaaaccattcttcataattcaatccatttactatgttatgttctgaggggagtgaaaattcccctaattcgatgaagattcttgctcaattgttatcagctatgcgccgaccagaacaccttgccgatcagccaaacgtctcttcaggccactgactagcgataactttccccacaacggaacaactctcattgcatgggatcattgggtactgtgggtttagtggttgtaaaaacacctgaccgctatccctgatcagtttcttgaaggtaaactcatcacccccaagtctggctatgcagaaatcacctggctcaacagcctgctcagggtcaacgagaattaacattccgtcaggaaagcttggcttggagcctgttggtgcggtcatggaattaccttcaacctcaagccagaatgcagaatcactggcttttttggttgtgcttacccatctctccgcatcacctttggtaaaggttctaagcttaggtgagaacatccctgcctgaacatgagaaaaaacagggtactcatactcacttctaagtgacggctgcatactaaccgcttcatacatctcgtagatttctctggcgattgaagggctaaattcttcaacgctaactttgagaatttttgcaagcaatgcggcgttataagcatttaatgcattgatgccattaaataaagcaccaacgcctgactgccccatccccatcttgtctgcgacagattcctgggataagccaagttcatttttctttttttcataaattgctttaaggcgacgtgcgtcctcaagctgctcttgtgttaatggtttcttttttgtgctcatacgttaaatctatcaccgcaagggataaatatctaacaccgtgcgtgttgactattttacctctggcggtgataatggttgcatgtactaaggaggttgtatggaacaacgcataaccctgaaagattatgcaatgcgctttgggcaaaccaagacagctaaagatctctcacctaccaaacaatgcccccctgcaaaaaataaattcatataaaaaacatacagataaccatctgcggtgataaattatctctggcggtgttgacataaataccactggcggtgatactgagcacatcagcaggacgcactgaccaccatgaaggtgacgctcttaaaaattaagccctgaagaagggcagcattcaaagcagaaggctttggggtgtgtgatacgaaacgaagcattgggatcatcacaagtttgtacaaaaaagctgaacgagaaacgtaaaatgatataaatatcaatatattaaattagattttgcataaaaaacagactacataatactgtaaaacacaacatatccagtcactatggcggccgctaagttggcagcatcacccgacgcactttgcgccgaataaatacctgtgacggaagatcacttcgcagaataaataaatcctggtgtccctgttgataccgggaagccctgggccaacttttggcgaaaatgagacgttgatcggcacgtaagaggttccaactttcaccataatgaaataagatcactaccgggcgtattttttgagttatcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtctgtgatggcttccatgtcggcagaatgcttaatgaattacaacagtactgcgatgagtggcagggcggggcgtaaacgcgtggatccggcttactaaaagccagataacagtatgcgtatttgcgcgctgatttttgcggtataagaatatatactgatatgtatacccgaagtatgtcaaaaagaggtgtgctatgaagcagcgtattacagtgacagttgacagcgacagctatcagttgctcaaggcatatatgatgtcaatatctccggtctggtaagcacaaccatgcagaatgaagcccgtcgtctgcgtgccgaacgctggaaagcggaaaatcaggaagggatggctgaggtcgcccggtttattgaaatgaacggctcttttgctgacgagaacagggactggtgaaatgcagtttaaggtttacacctataaaagagagagccgttatcgtctgtttgtggatgtacagagtgatattattgacacgcccgggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatataaatgtcaggctccgttatacacagccagtctgcaggtcgaccatagtgactggatatgttgtgttttacagtattatgtagtctgttttttatgcaaaatctaatttaatatattgatatttatatcattttacgtttctcgttcagctttcttgtacaaagtggtgataa

SEQ ID NO: 142 - DNA, 6422 bp, Artificial Sequence
  Description of Artificial Sequence: Synthetic pDEST14 polynucleotide
  gene (61)..(185): attR1
  gene (435)..(1094): CmR
  gene (1214)..(1298): inactivated ccdA
  gene (1436)..(1741): ccdB
  gene (1782)..(1906): attR2
  gene (2632)..(3489): ampR
cgatcccgcgaaattaatacgactcactatagggagaccacaacggtttccctctagatcacaagtttgtacaaaaaagctgaacgagaaacgtaaaatgatataaatatcaatatattaaattagattttgcataaaaaacagactacataatactgtaaaacacaacatatccagtcactatggcggccgctaagttggcagcatcacccgacgcactttgcgccgaataaatacctgtgacggaagatcacttcgcagaataaataaatcctggtgtccctgttgataccgggaagccctgggccaacttttggcgaaaatgagacgttgatcggcacgtaagaggttccaactttcaccataatgaaataagatcactaccgggcgtattttttgagttatcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtctgtgatggcttccatgtcggcagaatgcttaatgaattacaacagtactgcgatgagtggcagggcggggcgtaaacgcgtggatccggcttactaaaagccagataacagtatgcgtatttgcgcgctgatttttgcggtataagaatatatactgatatgtatacccgaagtatgtcaaaaagaggtgtgctatgaagcagcgtattacagtgacagttgacagcgacagctatcagttgctcaaggcatatatgatgtcaatatctccggtctggtaagcacaaccatgcagaatgaagcccgtcgtctgcgtgccgaacgctggaaagcggaaaatcaggaagggatggctgaggtcgcccggtttattgaaatgaacggctcttttgctgacgagaacagggactggtgaaatgcagtttaaggtttacacctataaaagagagagccgttatcgtctgtttgtggatgtacagagtgatattattgacacgcccgggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatataaatgtcaggctcccttatacacagccagtctgcaggtcgaccatagtgactggatatgttgtgttttacagtattatgtagtctgttttttatgcaaaatctaatttaatatattgatatttatatcattttacgtttctcgttcagctttcttgtacaaagtggtgatgatccggctgctaacaaagcccgaaaggaagctgagttggctgctgccaccgctgagcaataactagcataaccccttggggcctctaaacgggtcttgaggggttttttgctgaaaggaggaactatatccggatatccacaggacgggtgtggtcgccatgatcgcgtagtcgatagtggctccaagtagcgaagcgagcaggactgggcggcggccaaagcggtcggacagtgctccgagaacgggtgcgcatagaaattgcatcaacgcatatagcgctagcagcacgccatagtgactggcgatgctgtcggaatggacgatatcccgcaagaggcccggcagtaccggcataaccaagcctatgcctacagcatccagggtgacggtgccgaggatgacgatgagcgcattgttagatttcatacacggtgcctgactgcgttagcaatttaactgtgataaactaccgcattaaagcttatcgatgataagctgtcaaacatgagaattcttgaagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagctgcggtaaagctcatcagcgtggtcgtgaagcgattcacagatgtctgcctgttcatccgcgtccagctcgttgagtttctccagaagcgttaatgtctggcttctgataaagcgggccatgttaagggcggttttttcctgtttggtcactgatgcctccgtgtaagggggatttctgttcatgggggtaatgataccgatgaaacgagagaggatgctcacgatacgggttactgatgatgaacatgcccggttactggaacgttgtgagggtaaacaactggcggtatggatgcggcgggaccagagaaaaatcactcagggtcaatgccagcgcttcgttaatacagatgtaggtgttccacagggtagccagcagcatcctgcgatgcagatccggaacataatggtgcagggcgctgacttccgcgtttccagactttacgaaacacggaaaccgaagaccattcatgttgttgctcaggtcgcagacgttttgcagcagcagtcgcttcacgttcgctcgcgtatcggtgattcattctgctaaccagtaaggcaaccccgccagcctagccgggtcctcaacgacaggagcacgatcatgcgcacccgtggccaggacccaacgctgcccgagatgcgccgcgtgcggctgctggagatggcggacgcgatggatatgttctgccaagggttggtttgcgcattcacagttctccgcaagaattgattggctccaattcttggagtggtgaatccgttagcgaggtgccgccggcttccattcaggtcgaggtggcccggctccatgcaccgcgacgcaacgcggggaggcagacaaggtatagggcggcgcctacaatccatgccaacccgttccatgtgctcgccgaggcggcataaatcgccgtgacgatcagcggtccagtgatcgaagttaggctggtaagagccgcgagcgatccttgaagctgtccctgatggtcgtcatctacctgcctggacagcatggcctgcaacgcgggcatcccgatgccgccggaagcgagaagaatcataatggggaaggccatccagcctcgcgtcgcgaacgccagcaagacgtagcccagcgcgtcggccgccatgccggcgataatggcctgcttctcgccgaaacgtttggtggcgggaccagtgacgaaggcttgagcgagggcgtgcaagattccgaataccgcaagcgacaggccgatcatcgtcgcgctccagcgaaagcggtcctcgccgaaaatgacccagagcgctgccggcacctgtcctacgagttgcatgataaagaagacagtcataagtgcggcgacgatagtcatgccccgcgcccaccggaaggagctgactgggttgaaggctctcaagggcatcggtcgatcgacgctctcccttatgcgactcctgcattaggaagcagcccagtagtaggttgaggccgttgagcaccgccgccgcaaggaatggtgcatgcaaggagatggcgcccaacagtcccccggccacggggcctgccaccatacccacgccgaaacaagcgctcatgagcccgaagtggcgagcccgatcttccccatcggtgatgtcggcgatataggcgccagcaaccgcacctgtggcgccggtgatgccggccacgatgcgtccggcgtagaggatcgagatct

SEQ ID NO: 143 - DNA, 7013 bp, Artificial Sequence
  Description of Artificial Sequence: Synthetic pDEST15 polynucleotide
  gene (108)..(776): GST
  gene (792)..(916): attR1
  gene (1025)..(1537): CmR
  gene (1804)..(1888): inactivated ccdA
  gene (2026)..(2331): ccdB
  gene (2372)..(2496): attR2
  gene (3233)..(4093): ampR
atcgagatctcgatcccgcgaaattaatacgactcactatagggagaccacaacggtttccctctagaaataattttgtttaactttaagaaggagatatacatatgtcccctatactaggttattggaaaattaagggccttgtgcaacccactcgacttcttttggaatatcttgaagaaaaatatgaagagcatttgtatgagcgcgatgaaggtgataaatggcgaaacaaaaagtttgaattgggtttggagtttcccaatcttccttattatattgatggtgatgttaaattaacacagtctatggccatcatacgttatatagctgacaagcacaacatgttgggtggttgtccaaaagagcgtgcagagatttcaatgcttgaaggagcggttttggatattagatacggtgtttcgagaattgcatatagtaaagactttgaaactctcaaagttgattttcttagcaagctacctgaaatgctgaaaatgttcgaagatcgtttatgtcataaaacatatttaaatggtgatcatgtaacccatcctgacttcatgttgtatgacgctcttgatgttgttttatacatggacccaatgtgcctggatgcgttcccaaaattagtttgttttaaaaaacgtattgaagctatcccacaaattgataagtacttgaaatccagcaagtatatagcatggcctttgcagggctggcaagccacgtttggtggtggcgaccatcctccaaaatcggatctggttccgcgtccatggtcgaatcaaacaagtttgtacaaaaaagctgaacgagaaacgtaaaatgatataaatatcaatatattaaattagattttgcataaaaaacagactacataatactgtaaaacacaacatatccagtcactatggcggccgcattaggcaccccaggctttacactttatgcttccggctcgtataatgtgtggattttgagttaggatccgtcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtctgtgatggcttccatgtcggcagaatgcttaatgaattacaacagtactgcgatgagtggcagggcggggcgtaatctagaggatccggcttactaaaagccagataacagtatgcgtatttgcgcgctgatttttgcggtataagaatatatactgatatgtatacccgaagtatgtcaaaaagaggtgtgctatgaagcagcgtattacagtgacagttgacagcgacagctatcagttgctcaaggcatatatgatgtcaatatctccggtctggtaagcacaaccatgcagaatgaagcccgtcgtctgcgtgccgaacgctggaaagcggaaaatcaggaagggatggctgaggtcgcccggtttattgaaatgaacggctcttttgctgacgagaacagggactggtgaaatgcagtttaaggtttacacctataaaagagagagccgttatcgtctgtttgtggatgtacagagtgatattattgacacgcccgggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatataaatgtcaggctcccttatacacagccagtctgcaggtcgaccatagtgactggatatgttgtgttttacagtattatgtagtctgttttttatgcaaaatctaatttaatatattgatatttatatcattttacgtttctcgttcagctttcttgtacaaagtggtttgattcgacccgggatccggctgctaacaaagcccgaaaggaagctgagttggctgctgccaccgctgagcaataactagcataaccccttggggcctctaaacgggtcttgaggggttttttgctgaaaggaggaactatatccggatatccacaggacgggtgtggtcgccatgatcgcgtagtcgatagtggctccaagtagcgaagcgagcaggactgggcggcggccaaagcggtcggacagtgctccgagaacgggtgcgcatagaaattgcatcaacgcatatagcgctagcagcacgccatagtgactggcgatgctgtcggaatggacgatatcccgcaagaggcccggcagtaccggcataaccaagcctatgcctacagcatccagggtgacggtgccgaggatgacgatgagcgcattgttagatttcatacacggtgcctgactgcgttagcaatttaactgtgataaactaccgcattaaagcttatcgatgataagctgtcaaacatgagaattcttgaagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagctgcggtaaagctcatcagcgtggtcgtgaagcgattcacagatgtctgcctgttcatccgcgtccagctcgttgagtttctccagaagcgttaatgtctggcttctgataaagcgggccatgttaagggcggttttttcctgtttggtcactgatgcctccgtgtaagggggatttctgttcatgggggtaatgataccgatgaaacgagagaggatgctcacgatacgggttactgatgatgaacatgcccggttactggaacgttgtgagggtaaacaactggcggtatggatgcggcgggaccagagaaaaatcactcagggtcaatgccagcgcttcgttaatacagatgtaggtgttccacagggtagccagcagcatcctgcgatgcagatccggaacataatggtgcagggcgctgacttccgcgtttccagactttacgaaacacggaaaccgaagaccattcatgttgttgctcaggtcgcagacgttttgcagcagcagtcgcttcacgttcgctcgcgtatcggtgattcattctgctaaccagtaaggcaaccccgccagcctagccgggtcctcaacgacaggagcacgatcatgcgcacccgtggccaggacccaacgctgcccgagatgcgccgcgtgcggctgctggagatggcggacgcgatggatatgttctgccaagggttggtttgcgcattcacagttctccgcaagaattgattggctccaattcttggagtggtgaatccgttagcgaggtgccgccggcttccattcaggtcgaggtggcccggctccatgcaccgcgacgcaacgcggggaggcagacaaggtatagggcggcgcctacaatccatgccaacccgttccatgtgctcgccgaggcggcataaatcgccgtgacgatcagcggtccagtgatcgaagttaggctggtaagagccgcgagcgatccttgaagctgtccctgatggtcgtcatctacctgcctggacagcatggcctgcaacgcgggcatcccgatgccgccggaagcgagaagaatcataatggggaaggccatccagcctcgcgtcgcgaacgccagcaagacgtagcccagcgcgtcggccgccatgccggcgataatggcctgcttctcgccgaaacgtttggtggcgggaccagtgacgaaggcttgagcgagggcgtgcaagattccgaataccgcaagcgacaggccgatcatcgtcgcgctccagcgaaagcggtcctcgccgaaaatgacccagagcgctgccggcacctgtcctacgagttgcatgataaagaagacagtcataagtgcggcgacgatagtcatgccccgcgcccaccggaaggagctgactgggttgaaggctctcaagggcatcggtcgatcgacgctctcccttatgcgactcctgcattaggaagcagcccagtagtaggttgaggccgttgagcaccgccgccgcaaggaatggtgcatgcaaggagatggcgcccaacagtcccccggccacggggcctgccaccatacccacgccgaaacaagcgctcatgagcccgaagtggcgagcccgatcttccccatcggtgatgtcggcgatataggcgccagcaaccgcacctgtggcgccggtgatgccggccacgatgcgtccggcgtagagg

SEQ ID NO: 144 - DNA, 6675 bp, Artificial Sequence
  Description of Artificial Sequence: Synthetic pDEST16 polynucleotide
  gene (104)..(457): trxA
  gene (461)..(585): attR1
  gene (694)..(1353): CmR
  gene (1473)..(1557): inactivated ccdA
  gene (1695)..(2000): ccdB
  gene (2041)..(2165): attR2
agatctcgatcccgcgaaattaatacgactcactatagggagaccacaacggtttccctctagaaataattttgtttaactttaagaaggagatatacatatgagcgataaaattattcacctgactgacgacagttttgacacggatgtactcaaagcggacggggcgatcctcgtcgatttctgggcagagtggtgcggtccgtgcaaaatgatcgccccgattctggatgaaatcgctgacgaatatcagggcaaactgaccgttgcaaaactgaacatcgatcaaaaccctggcactgcgccgaaatatggcatccgtggtatcccgactctgctgctgttcaaaaacggtgaagtggcggcaaccaaagtgggtgcactgtctaaaggtcagttgaaagagttcctcgacgctaacctggccggttctggttctggtgatgacgatgacaagatcacaagtttgtacaaaaaagctgaacgagaaacgtaaaatgatataaatatcaatatattaaattagattttgcataaaaaacagactacataatactgtaaaacacaacatatccagtcactatggcggccgcattaggcaccccaggctttacactttatgcttccggctcgtataatgtgtggattttgagttaggatccggcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtctgtgatggcttccatgtcggcagaatgcttaatgaattacaacagtactgcgatgagtggcagggcggggcgtaaacgcgtggatccggcttactaaaagccagataacagtatgcgtatttgcgcgctgatttttgcggtataagaatatatactgatatgtatacccgaagtatgtcaaaaagaggtgtgctatgaagcagcgtattacagtgacagttgacagcgacagctatcagttgctcaaggcatatatgatgtcaatatctccggtctggtaagcacaaccatgcagaatgaagcccgtcgtctgcgtgccgaacgctggaaagcggaaaatcaggaagggatggctgaggtcgcccggtttattgaaatgaacggctcttttgctgacgagaacagggactggtgaaatgcagtttaaggtttacacctataaaagagagagccgttatcgtctgtttgtggatgtacagagtgatattattgacacgcccgggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatataaatgtcaggctcccttatacacagccagtctgcaggtcgaccatagtgactggatatgttgtgttttacagtattatgtagtctgttttttatgcaaaatctaatttaatatattgatatttatatcattttacgtttctcgttcagctttcttgtacaaagtggtgatgatccggctgctaacaaagcccgaaaggaagctgagttggctgctgccaccgctgagcaataactagcataaccccttggggcctctaaacgggtcttgaggggttttttgctgaaaggaggaactatatccggatatccacaggacgggtgtggtcgccatgatcgcgtagtcgatagtggctccaagtagcgaagcgagcaggactgggcggcggccaaagcggtcggacagtgctccgagaacgggtgcgcatagaaattgcatcaacgcatatagcgctagcagcacgccatagtgactggcgatgctgtcggaatggacgatatcccgcaagaggcccggcagtaccggcataaccaagcctatgcctacagcatccagggtgacggtgccgaggatgacgatgagcgcattgttagatttcatacacggtgcctgactgcgttagcaatttaactgtgataaactaccgcattaaagcttatcgatgataagctgtcaaacatgagaattcttgaagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagctgcggtaaagctcatcagcgtggtcgtgaagcgattcacagatgtctgcctgttcatccgcgtccagctcgttgagtttctccagaagcgttaatgtctggcttctgataaagcgggccatgttaagggcggttttttcctgtttggtcactgatgcctccgtgtaagggggatttctgttcatgggggtaatgataccgatgaaacgagagaggatgctcacgatacgggttactgatgatgaacatgcccggttactggaacgttgtgagggtaaacaactggcggtatggatgcggcgggaccagagaaaaatcactcagggtcaatgccagcgcttcgttaatacagatgtaggtgttccacagggtagccagcagcatcctgcgatgcagatccggaacataatggtgcagggcgctgacttccgcgtttccagactttacgaaacacggaaaccgaagaccattcatgttgttgctcaggtcgcagacgttttgcagcagcagtcgcttcacgttcgctcgcgtatcggtgattcattctgctaaccagtaaggcaaccccgccagcctagccgggtcctcaacgacaggagcacgatcatgcgcacccgtggccaggacccaacgctgcccgagatgcgccgcgtgcggctgctggagatggcggacgcgatggatatgttctgccaagggttggtttgcgcattcacagttctccgcaagaattgattggctccaattcttggagtggtgaatccgttagcgaggtgccgccggcttccattcaggtcgaggtggcccggctccatgcaccgcgacgcaacgcggggaggcagacaaggtatagggcggcgcctacaatccatgccaacccgttccatgtgctcgccgaggcggcataaatcgccgtgacgatcagcggtccagtgatcgaagttaggctggtaagagccgcgagcgatccttgaagctgtccctgatggtcgtcatctacctgcctggacagcatggcctgcaacgcgggcatcccgatgccgccggaagcgagaagaatcataatggggaaggccatccagcctcgcgtcgcgaacgccagcaagacgtagcccagcgcgtcggccgccatgccggcgataatggcctgcttctcgccgaaacgtttggtggcgggaccagtgacgaaggcttgagcgagggcgtgcaagattccgaataccgcaagcgacaggccgatcatcgtcgcgctccagcgaaagcggtcctcgccgaaaatgacccagagcgctgccggcacctgtcctacgagttgcatgataaagaagacagtcataagtgcggcgacgatagtcatgccccgcgcccaccggaaggagctgactgggttgaaggctctcaagggcatcggtcgatcgacgctctcccttatgcgactcctgcattaggaagcagcccagtagtaggttgaggccgttgagcaccgccgccgcaaggaatggtgcatgcaaggagatggcgcccaacagtcccccggccacggggcctgccaccatacccacgccgaaacaagcgctcatgagcccgaagtggcgagcccgatcttccccatcggtgatgtcggcgatataggcgccagcaaccgcacctgtggcgccggtgatgccggccacgatgcgtccggcgtagaggatcg

SEQ ID NO: 145 - DNA, 6354 bp, Artificial Sequence
  Description of Artificial Sequence: Synthetic pDEST17 polynucleotide
  gene (134)..(258): attR1
  gene (367)..(1026): CmR
  gene (1146)..(1230): inactivated ccdA
  gene (1368)..(1673): ccdB
  gene (1714)..(1838): attR2
  gene (2564)..(3421): ampR
cgatcccgcgaaattaatacgactcactatagggagaccacaacggtttccctctagaaataattttgtttaactttaagaaggagatatacatatgtcgtactaccatcaccatcaccatcacctcgaatcaacaagtttgtacaaaaaagctgaacgagaaacgtaaaatgatataaatatcaatatattaaattagattttgcataaaaaacagactacataatactgtaaaacacaacatatccagtcactatggcggccgcattaggcaccccaggctttacactttatgcttccggctcgtataatgtgtggattttgagttaggatccgtcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtctgtgatggcttccatgtcggcagaatgcttaatgaattacaacagtactgcgatgagtggcagggcggggcgtaaagatctggatccggcttactaaaagccagataacagtatgcgtatttgcgcgctgatttttgcggtataagaatatatactgatatgtatacccgaagtatgtcaaaaagaggtgtgctatgaagcagcgtattacagtgacagttgacagcgacagctatcagttgctcaaggcatatatgatgtcaatatctccggtctggtaagcacaaccatgcagaatgaagcccgtcgtctgcgtgccgaacgctggaaagcggaaaatcaggaagggatggctgaggtcgcccggtttattgaaatgaacggctcttttgctgacgagaacagggactggtgaaatgcagtttaaggtttacacctataaaagagagagccgttatcgtctgtttgtggatgtacagagtgatattattgacacgcccgggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatataaatgtcaggctcccttatacacagccagtctgcaggtcgaccatagtgactggatatgttgtgttttacagtattatgtagtctgttttttatgcaaaatctaatttaatatattgatatttatatcattttacgtttctcgttcagctttcttgtacaaagtggttgattcgaggctgctaacaaagcccgaaaggaagctgagttggctgctgccaccgctgagcaataactagcataaccccttggggcctctaaacgggtcttgaggggttttttgctgaaaggaggaactatatccggatatccacaggacgggtgtggtcgccatgatcgcgtagtcgatagtggctccaagtagcgaagcgagcaggactgggcggcggccaaagcggtcggacagtgctccgagaacgggtgcgcatagaaattgcatcaacgcatatagcgctagcagcacgccatagtgactggcgatgctgtcggaatggacgatatcccgcaagaggcccggcagtaccggcataaccaagcctatgcctacagcatccagggtgacggtgccgaggatgacgatgagcgcattgttagatttcatacacggtgcctgactgcgttagcaatttaactgtgataaactaccgcattaaagcttatcgatgataagctgtcaaacatgagaattcttgaagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagctgcggtaaagctcatcagcgtggtcgtgaagcgattcacagatgtctgcctgttcatccgcgtccagctcgttgagtttctccagaagcgttaatgtctggcttctgataaagcgggccatgttaagggcggttttttcctgtttggtcactgatgcctccgtgtaagggggatttctgttcatgggggtaatgataccgatgaaacgagagaggatgctcacgatacgggttactgatgatgaacatgcccggttactggaacgttgtgagggtaaacaactggcggtatggatgcggcgggaccagagaaaaatcactcagggtcaatgccagcgcttcgttaatacagatgtaggtgttccacagggtagccagcagcatcctgcgatgcagatccggaacataatggtgcagggcgctgacttccgcgtttccagactttacgaaacacggaaaccgaagaccattcatgttgttgctcaggtcgcagacgttttgcagcagcagtcgcttcacgttcgctcgcgtatcggtgattcattctgctaaccagtaaggcaaccccgccagcctagccgggtcctcaacgacaggagcacgatcatgcgcacccgtggccaggacccaacgctgcccgagatgcgccgcgtgcggctgctggagatggcggacgcgatggatatgttctgccaagggttggtttgcgcattcacagttctccgcaagaattgattggctccaattcttggagtggtgaatccgttagcgaggtgccgccggcttccattcaggtcgaggtggcccggctccatgcaccgcgacgcaacgcggggaggcagacaaggtatagggcggcgcctacaatccatgccaacccgttccatgtgctcgccgaggcggcataaatcgccgtgacgatcagcggtccagtgatcgaagttaggctggtaagagccgcgagcgatccttgaagctgtccctgatggtcgtcatctacctgcctggacagcatggcctgcaacgcgggcatcccgatgccgccggaagcgagaagaatcataatggggaaggccatccagcctcgcgtcgcgaacgccagcaagacgtagcccagcgcgtcggccgccatgccggcgataatggcctgcttctcgccgaaacgtttggtggcgggaccagtgacgaaggcttgagcgagggcgtgcaagattccgaataccgcaagcgacaggccgatcatcgtcgcgctccagcgaaagcggtcctcgccgaaaatgacccagagcgctgccggcacctgtcctacgagttgcatgataaagaagacagtcataagtgcggcgacgatagtcatgccccgcgcccaccggaaggagctgactgggttgaaggctctcaagggcatcggtcgatcgacgctctcccttatgcgactcctgcattaggaagcagcccagtagtaggttgaggccgttgagcaccgccgccgcaaggaatggtgcatgcaaggagatggcgcccaacagtcccccggccacggggcctgccaccatacccacgccgaaacaagcgctcatgagcccgaagtggcgagcccgatcttccccatcggtgatgtcggcgatataggcgccagcaaccgcacctgtggcgccggtgatgccggccacgatgcgtccggcgtagaggatcgagatct

SEQ ID NO: 146 - DNA, 6613 bp, Artificial Sequence
  Description of Artificial Sequence: Synthetic pDEST18 polynucleotide
  gene (474)..(1449): ampR
  gene (1590)..(2244): ori
  gene (2738)..(3850): genR
  gene (4127)..(4251): attR1
  gene (4501)..(5160): CmR
  gene (5280)..(5364): inactivated ccdA
  gene (5502)..(5807): ccdB
  gene (5848)..(5972): attR2
  gene (25)..(6595): lacZ
gacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcagaccagccgcgtaacctggcaaaatcggttacggttgagtaataaatggatgccctgcgtaagcgggtgtgggcggacaataaagtcttaaactgaacaaaatagatctaaactatgacaataaagtcttaaactagacagaatagttgtaaactgaaatcagtccagttatgctgtgaaaaagcatactggacttttgttatggctaaagcaaactcttcattttctgaagtgcaaattgcccgtcgtattaaagaggggcgtggccaagggcatggtaaagactatattcgcggcgttgtgacaatttaccgaacaactccgcggccgggaagccgatctcggcttgaacgaattgttaggtggcggtacttgggtcgatatcaaagtgcatcacttcttcccgtatgcccaactttgtatagagagccactgcgggatcgtcaccgtaatctgcttgcacgtagatcacataagcaccaagcgcgttggcctcatgcttgaggagattgatgagcgcggtggcaatgccctgcctccggtgctcgccggagactgcgagatcatagatatagatctcactacgcggctgctcaaacctgggcagaacgtaagccgcgagagcgccaacaaccgcttcttggtcgaaggcagcaagcgcgatgaatgtcttactacggagcaagttcccgaggtaatcggagtccggctgatgttgggagtaggtggctacgtctccgaactcacgaccgaaaagatcaagagcagcccgcatggatttgacttggtcagggccgagcctacatgtgcgaatgatgcccatacttgagccacctaactttgttttagggcgactgccctgctgcgtaacatcgttgctgctgcgtaacatcgttgctgctccataacatcaaacatcgacccacggcgtaacgcgcttgctgcttggatgcccgaggcatagactgtacaaaaaaacagtcataacaagccatgaaaaccgccactgcgccgttaccaccgctgcgttcggtcaaggttctggaccagttgcgtgagcgcatacgctacttgcattacagtttacgaaccgaacaggcttatgtcaactgggttcgtgccttcatccgtttccacggtgtgcgtcacccggcaaccttgggcagcagcgaagtcgaggcatttctgtcctggctggcgaacgagcgcaaggtttcggtctccacgcatcgtcaggcattggcggccttgctgttcttctacggcaaggtgctgtgcacggatctgccctggcttcaggagatcggaagacctcggccgtcgcggcgcttgccggtggtgctgaccccggatgaagtggttcgcatcctcggttttctggaaggcgagcatcgtttgttcgcccaggactctagctatagttctagtggttggctacgtatcgagcaagaaaataaaacgccaaacgcgttggagtcttgtgtgctatttttacaaagattcagaaatacgcatcacttacaacaagggggactatgaaattatgcattttgaggatgccgggacctttaattcaacccaacacaatatattatagttaaataagaattatttatcaaatcatttgtatattaattaaaatactatactgtaaattacattttatttacaatgaggatcatcacaagtttgtacaaaaaagctgaacgagaaacgtaaaatgatataaatatcaatatattaaattagattttgcataaaaaacagactacataatactgtaaaacacaacatatccagtcactatggcggccgctaagttggcagcatcacccgacgcactttgcgccgaataaatacctgtgacggaagatcacttcgcagaataaataaatcctggtgtccctgttgataccgggaagccctgggccaacttttggcgaaaatgagacgttgatcggcacgtaagaggttccaactttcaccataatgaaataagatcactaccgggcgtattttttgagttatcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtctgtgatggcttccatgtcggcagaatgcttaatgaattacaacagtactgcgatgagtggcagggcggggcgtaaacgcgtggatccggcttactaaaagccagataacagtatgcgtatttgcgcgctgatttttgcggtataagaatatatactgatatgtatacccgaagtatgtcaaaaagaggtgtgctatgaagcagcgtattacagtgacagttgacagcgacagctatcagttgctcaaggcatatatgatgtcaatatctccggtctggtaagcacaaccatgcagaatgaagcccgtcgtctgcgtgccgaacgctggaaagcggaaaatcaggaagggatggctgaggtcgcccggtttattgaaatgaacggctcttttgctgacgagaacagggactggtgaaatgcagtttaaggtttacacctataaaagagagagccgttatcgtctgtttgtggatgtacagagtgatattattgacacgcccgggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatataaatgtcaggctcccttatacacagccagtctgcaggtcgaccatagtgactggatatgttgtgttttacagtattatgtagtctgttttttatgcaaaatctaatttaatatattgatatttatatcattttacgtttctcgttcagctttcttgtacaaagtggtgatagcttgtcgagaagtactagaggatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggatctgatcactgcttgagcctaggagatccgaaccagataagtgaaatctagttccaaactattttgtcatttttaattttcgtattagcttacgacgctacacccagttcccatctattttgtcactcttccctaaataatccttaaaaactccatttccacccctcccagttcccaactattttgtccgcccacagcggggcatttttcttcctgttatgtttttaatcaaacatcctgccaactccatgtgacaaaccgtcatcttcggctactttttctctgtcacagaatgaaaatttttctgtcatctcttcgttattaatgtttgtaattgactgaatatcaacgcttatttgcagcctgaatggcgaatg

SEQ ID NO: 147 - DNA, 6668 bp, Artificial Sequence
  Description of Artificial Sequence: Synthetic pDEST19 polynucleotide
  gene (391)..(515): attR1
  gene (765)..(1424): CmR
  gene (1544)..(1628): inactivated ccdA
  gene (1766)..(2071): ccdB
  gene (2112)..(2236): attR2
  gene (2852)..(2895): lacZ
  gene (3344)..(4319): ampR
  gene (4460)..(5114): ori
  gene (52)..(5608): genR
agtggttcgcatcctcggttttctggaaggcgagcatcgtttgttcgcccaggactctagctatagttctagtggttggctacgtatatcaaatacttgtaggtgacgccgtcatctttccattgtaacgtaaatggcaacttgtagatgaacgcgctgtcaaaaaaccggccagtttcttccacaaactcgcgcacggctgtctcgtaaacttttgcgtcgcaacaatcgcgatgacctcgtggtatggaaattttttctaaaaaagtgtcgttcatgtcggcggcgggcgcgttcgcgctccggtacgcgcgacgggcacacagcaggacagccttgtccggctcgattatcataaacaatcctgcaggcatgcaagctcggatcatcacaagtttgtacaaaaaagctgaacgagaaacgtaaaatgatataaatatcaatatattaaattagattttgcataaaaaacagactacataatactgtaaaacacaacatatccagtcactatggcggccgctaagttggcagcatcacccgacgcactttgcgccgaataaatacctgtgacggaagatcacttcgcagaataaataaatcctggtgtccctgttgataccgggaagccctgggccaacttttggcgaaaatgagacgttgatcggcacgtaagaggttccaactttcaccataatgaaataagatcactaccgggcgtattttttgagttatcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtctgtgatggcttccatgtcggcagaatgcttaatgaattacaacagtactgcgatgagtggcagggcggggcgtaaacgcgtggatccggcttactaaaagccagataacagtatgcgtatttgcgcgctgatttttgcggtataagaatatatactgatatgtatacccgaagtatgtcaaaaagaggtgtgctatgaagcagcgtattacagtgacagttgacagcgacagctatcagttgctcaaggcatatatgatgtcaatatctccggtctggtaagcacaaccatgcagaatgaagcccgtcgtctgcgtgccgaacgctggaaagcggaaaatcaggaagggatggctgaggtcgcccggtttattgaaatgaacggctcttttgctgacgagaacagggactggtgaaatgcagtttaaggtttacacctataaaagagagagccgttatcgtctgtttgtggatgtacagagtgatattattgacacgcccgggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatataaatgtcaggctcccttatacacagccagtctgcaggtcgaccatagtgactggatatgttgtgttttacagtattatgtagtctgttttttatgcaaaatctaatttaatatattgatatttatatcattttacgtttctcgttcagctttcttgtacaaagtggtgatcgagaagtactagaggatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggatctgatcactgcttgagcctaggagatccgaaccagataagtgaaatctagttccaaactattttgtcatttttaattttcgtattagcttacgacgctacacccagttcccatctattttgtcactcttccctaaataatccttaaaaactccatttccacccctcccagttcccaactattttgtccgcccacagcggggcatttttcttcctgttatgtttttaatcaaacatcctgccaactccatgtgacaaaccgtcatcttcggctactttttctctgtcacagaatgaaaatttttctgtcatctcttcgttattaatgtttgtaattgactgaatatcaacgcttatttgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcagaccagccgcgtaacctggcaaaatcggttacggttgagtaataaatggatgccctgcgtaagcgggtgtgggcggacaataaagtcttaaactgaacaaaatagatctaaactatgacaataaagtcttaaactagacagaatagttgtaaactgaaatcagtccagttatgctgtgaaaaagcatactggacttttgttatggctaaagcaaactcttcattttctgaagtgcaaattgcccgtcgtattaaagaggggcgtggccaagggcatggtaaagactatattcgcggcgttgtgacaatttaccgaacaactccgcggccgggaagccgatctcggcttgaacgaattgttaggtggcggtacttgggtcgatatcaaagtgcatcacttcttcccgtatgcccaactttgtatagagagccactgcgggatcgtcaccgtaatctgcttgcacgtagatcacataagcaccaagcgcgttggcctcatgcttgaggagattgatgagcgcggtggcaatgccctgcctccggtgctcgccggagactgcgagatcatagatatagatctcactacgcggctgctcaaacctgggcagaacgtaagccgcgagagcgccaacaaccgcttcttggtcgaaggcagcaagcgcgatgaatgtcttactacggagcaagttcccgaggtaatcggagtccggctgatgttgggagtaggtggctacgtctccgaactcacgaccgaaaagatcaagagcagcccgcatggatttgacttggtcagggccgagcctacatgtgcgaatgatgcccatacttgagccacctaactttgttttagggcgactgccctgctgcgtaacatcgttgctgctgcgtaacatcgttgctgctccataacatcaaacatcgacccacggcgtaacgcgcttgctgcttggatgcccgaggcatagactgtacaaaaaaacagtcataacaagccatgaaaaccgccactgcgccgttaccaccgctgcgttcggtcaaggttctggaccagttgcgtgagcgcatacgctacttgcattacagtttacgaaccgaacaggcttatgtcaactgggttcgtgccttcatccgtttccacggtgtgcgtcacccggcaaccttgggcagcagcgaagtcgaggcatttctgtcctggctggcgaacgagcgcaaggtttcggtctccacgcatcgtcaggcattggcggccttgctgttcttctacggcaaggtgctgtgcacggatctgccctggcttcaggagatcggaagacctcggccgtcgcggcgcttgccggtggtgctgaccccggatga

SEQ ID NO: 148 - DNA, 7066 bp, Artificial Sequence
  Description of Artificial Sequence: Synthetic pDEST20 polynucleotide
  gene (592)..(1263): GST
  gene (1273)..(1397): attR1
  gene (1506)..(2165): CmR
  gene (2285)..(2369): inactivated ccdA
  gene (2507)..(2812): ccdB
  gene (2853)..(2977): attR2
  gene (4214)..(5064): ampR
  gene (5263)..(5843): ori
ccactgcgccgttaccaccgctgcgttcggtcaaggttctggaccagttgcgtgagcgcatacgctacttgcattacagtttacgaaccgaacaggcttatgtcaactgggttcgtgccttcatccgtttccacggtgtgcgtcacccggcaaccttgggcagcagcgaagtcgaggcatttctgtcctggctggcgaacgagcgcaaggtttcggtctccacgcatcgtcaggcattggcggccttgctgttcttctacggcaaggtgctgtgcacggatctgccctggcttcaggagatcggaagacctcggccgtcgcggcgcttgccggtggtgctgaccccggatgaagtggttcgcatcctcggttttctggaaggcgagcatcgtttgttcgcccaggactctagctatagttctagtggttggctacgtatactccggaatattaatagatcatggagataattaaaatgataaccatctcgcaaataaataagtattttactgttttcgtaacagttttgtaataaaaaaacctataaatattccggattattcataccgtcccaccatcgggcgcggatccatggcccctatactaggttattggaaaattaagggccttgtgcaacccactcgacttcttttggaatatcttgaagaaaaatatgaagagcatttgtatgagcgcgatgaaggtgataaatggcgaaacaaaaagtttgaattgggtttggagtttcccaatcttccttattatattgatggtgatgttaaattaacacagtctatggccatcatacgttatatagctgacaagcacaacatgttgggtggttgtccaaaagagcgtgcagagatttcaatgcttgaaggagcggttttggatattagatacggtgtttcgagaattgcatatagtaaagactttgaaactctcaaagttgattttcttagcaagctacctgaaatgctgaaaatgttcgaagatcgtttatgtcataaaacatatttaaatggtgatcatgtaacccatcctgacttcatgttgtatgacgctcttgatgttgttttatacatggacccaatgtgcctggatgcgttcccaaaattagtttgttttaaaaaacgtattgaagctatcccacaaattgataagtacttgaaatccagcaagtatatagcatggcctttgcagggctggcaagccacgtttggtggtggcgaccatcctccaaaatcggatctggttccgcgtcataatcaaacaagtttgtacaaaaaagctgaacgagaaacgtaaaatgatataaatatcaatatattaaattagattttgcataaaaaacagactacataatactgtaaaacacaacatatccagtcactatggcggccgcattaggcaccccaggctttacactttatgcttccggctcgtatgttgtgtggattttgagttaggatccggcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtctgtgatggcttccatgtcggcagaatgcttaatgaattacaacagtactgcgatgagtggcagggcggggcgtaatctagaggatccggcttactaaaagccagataacagtatgcgtatttgcgcgctgatttttgcggtataagaatatatactgatatgtatacccgaagtatgtcaaaaagaggtgtgctatgaagcagcgtattacagtgacagttgacagcgacagctatcagttgctcaaggcatatatgatgtcaatatctccggtctggtaagcacaaccatgcagaatgaagcccgtcgtctgcgtgccgaacgctggaaagcggaaaatcaggaagggatggctgaggtcgcccggtttattgaaatgaacggctcttttgctgacgagaacagggactggtgaaatgcagtttaaggtttacacctataaaagagagagccgttatcgtctgtttgtggatgtacagagtgatattattgacacgcccgggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatataaatgtcaggctcccttatacacagccagtctgcaggtcgaccatagtgactggatatgttgtgttttacagtattatgtagtctgttttttatgcaaaatctaatttaatatattgatatttatatcattttacgtttctcgttcagctttcttgtacaaagtggtttgatagcttgtcgagaagtactagaggatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggatctgatcactgcttgagcctaggagatccgaaccagataagtgaaatctagttccaaactattttgtcatttttaattttcgtattagcttacgacgctacacccagttcccatctattttgtcactcttccctaaataatccttaaaaactccatttccacccctcccagttcccaactattttgtccgcccacagcggggcatttttcttcctgttatgtttttaatcaaacatcctgccaactccatgtgacaaaccgtcatcttcggctactttttctctgtcacagaatgaaaatttttctgtcatctcttcgttattaatgtttgtaattgactgaatatcaacgcttatttgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcagaccagccgcgtaacctggcaaaatcggttacggttgagtaataaatggatgccctgcgtaagcgggtgtgggcggacaataaagtcttaaactgaacaaaatagatctaaactatgacaataaagtcttaaactagacagaatagttgtaaactgaaatcagtccagttatgctgtgaaaaagcatactggacttttgttatggctaaagcaaactcttcattttctgaagtgcaaattgcccgtcgtattaaagaggggcgtggccaagggcatggtaaagactatattcgcggcgttgtgacaatttaccgaacaactccgcggccgggaagccgatctcggcttgaacgaattgttaggtggcggtacttgggtcgatatcaaagtgcatcacttcttcccgtatgcccaactttgtatagagagccactgcgggatcgtcaccgtaatctgcttgcacgtagatcacataagcaccaagcgcgttggcctcatgcttgaggagattgatgagcgcggtggcaatgccctgcctccggtgctcgccggagactgcgagatcatagatatagatctcactacgcggctgctcaaacctgggcagaacgtaagccgcgagagcgccaacaaccgcttcttggtcgaaggcagcaagcgcgatgaatgtcttactacggagcaagttcccgaggtaatcggagtccggctgatgttgggagtaggtggctacgtctccgaactcacgaccgaaaagatcaagagcagcccgcatggatttgacttggtcagggccgagcctacatgtgcgaatgatgcccatacttgagccacctaactttgttttagggcgactgccctgctgcgtaacatcgttgctgctgcgtaacatcgttgctgctccataacatcaaacatcgacccacggcgtaacgcgcttgctgcttggatgcccgaggcatagactgtacaaaaaaacagtcataacaagccatgaaaaccg

SEQ ID NO: 149 - DNA, 11713 bp, Artificial Sequence
  Description of Artificial Sequence: Synthetic pDEST21 polynucleotide
  gene (857)..(1322): GAL4DB
  gene (1332)..(1456): attR1
  gene (1706)..(2365): CmR
  gene (2485)..(2569): inactivated ccdA
  gene (2707)..(3012): ccdB
  gene (3053)..(3177): attR2
  gene (3716)..(3735): pT7 (T7 promoter)
  gene (3899)..(4354): f1 (f1 intergenic region)
  gene (4414)..(6642): Leu2
  gene (7541)..(8515): kanR
  gene (9668)..(10958): CYH2
  gene (848)..(11118): pADH (ADH promoter)
tttattatgttacaatatggaagggaactttacacttctcctatgcacatatattaattaaagtccaatgctagtagagaaggggggtaacacccctccgcgctcttttccgatttttttctaaaccgtggaatatttcggatatccttttgttgtttccgggtgtacaatatggacttcctcttttctggcaaccaaacccatacatcgggattcctataataccttcgttggtctccctaacatgtaggtggcggaggggagatatacaatagaacagataccagacaagacataatgggctaaacaagactacaccaattacactgcctcattgatggtggtacataacgaactaatactgtagccctagacttgatagccatcatcatatcgaagtttcactaccctttttccatttgccatctattgaagtaataataggcgcatgcaacttcttttctttttttttcttttctctctcccccgttgttgtctcaccatatccgcaatgacaaaaaaaatgatggaagacactaaaggaaaaaattaacgacaaagacagcaccaacagatgtcgttgttccagagctgatgaggggtatcttcgaacacacgaaactttttccttccttcattcacgcacactactctctaatgagcaacggtatacggccttccttccagttacttgaatttgaaataaaaaaagtttgccgctttgctatcaagtataaatagacctgcaattattaatcttttgtttcctcgtcattgttctcgttccctttcttccttgtttctttttctgcacaatatttcaagctataccaagcatacaatcaactccaagcttgaagcaagcctcctgaaagatgaagctactgtcttctatcgaacaagcatgcgatatttgccgacttaaaaagctcaagtgctccaaagaaaaaccgaagtgcgccaagtgtctgaagaacaactgggagtgtcgctactctcccaaaaccaaaaggtctccgctgactagggcacatctgacagaagtggaatcaaggctagaaagactggaacagctatttctactgatttttcctcgagaagaccttgacatgattttgaaaatggattctttacaggatataaaagcattgttaacaggattatttgtacaagataatgtgaataaagatgccgtcacagatagattggcttcagtggagactgatatgcctctaacattgagacagcatagaataagtgcgacatcatcatcggaagagagtagtaacaaaggtcaaagacagttgactgtatcgtcgaggtcgaatcaaacaagtttgtacaaaaaagctgaacgagaaacgtaaaatgatataaatatcaatatattaaattagattttgcataaaaaacagactacataatactgtaaaacacaacatatccagtcactatggcggccgctaagttggcagcatcacccgacgcactttgcgccgaataaatacctgtgacggaagatcacttcgcagaataaataaatcctggtgtccctgttgataccgggaagccctgggccaacttttggcgaaaatgagacgttgatcggcacgtaagaggttccaactttcaccataatgaaataagatcactaccgggcgtattttttgagttatcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtctgtgatggcttccatgtcggcagaatgcttaatgaattacaacagtactgcgatgagtggcagggcggggcgtaatctagaggatccggcttactaaaagccagataacagtatgcgtatttgcgcgctgatttttgcggtataagaatatatactgatatgtatacccgaagtatgtcaaaaagaggtgtgctatgaagcagcgtattacagtgacagttgacagcgacagctatcagttgctcaaggcatatatgatgtcaatatctccggtctggtaagcacaaccatgcagaatgaagcccgtcgtctgcgtgccgaacgctggaaagcggaaaatcaggaagggatggctgaggtcgcccggtttattgaaatgaacggctcttttgctgacgagaacagggactggtgaaatgcagtttaaggtttacacctataaaagagagagccgttatcgtctgtttgtggatgtacagagtgatattattgacacgcccgggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatataaatgtcaggctcccttatacacagccagtctgcaggtcgaccatagtgactggatatgttgtgttttacagtattatgtagtctgttttttatgcaaaatctaatttaatatattgatatttatatcattttacgtttctcgttcagctttcttgtacaaagtggtttgatggccgctaagtaagtaagacgtcgagctctaagtaagtaacggccgccaccgcggtggagctttggacttcttcgccagaggtttggtcaagtctccaatcaaggttgtcggcttgtctaccttgccagaaatttacgaaaagatggaaaagggtcaaatcgttggtagatacgttgttgacacttctaaataagcgaatttcttatgatttatgatttttattattaaataagttataaaaaaaataagtgtatacaaattttaaagtgactcttaggttttaaaacgaaaattcttattcttgagtaactctttcctgtaggtcaggttgctttctcaggtatagcatgaggtcgctcttattgaccacacctctaccggcatgccgagcaaatgcctgcaaatcgctccccatttcacccaattgtagatatgctaactccagcaatgagttgatgaatctcggtgtgtattttatgtcctcagaggacaatacctgttgtaatcgttcttccacacggatcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcctgatgcggtattttctccttacgcatctgtgcggtatttcacaccgcatatcgaccggtcgaggagaacttctagtatatccacatacctaatattattgccttattaaaaatggaatcggaacaattacatcaaaatccacattctcttcaaaatcaattgtcctgtacttccttgttcatgtgtgttcaaaaacgttatatttataggataattatactctatttctcaacaagtaattggttgtttggccgagcggtctaaggcgcctgattcaagaaatatcttgaccgcagttaactgtgggaatactcaggtatcgtaagatgcaagagttcgaatctcttagcaaccattatttttttcctcaacataacgagaacacacaggggcgctatcgcacagaatcaaattcgatgactggaaattttttgttaatttcagaggtcgcctgacgcatatacctttttcaactgaaaaattgggagaaaaaggaaaggtgagaggccggaaccggcttttcatatagaatagagaagcgttcatgactaaatgcttgcatcacaatacttgaagttgacaatattatttaaggacctattgttttttccaataggtggttagcaatcgtcttactttctaacttttcttaccttttacatttcagcaatatatatatatatttcaaggatataccattctaatgtctgcccctatgtctgcccctaagaagatcgtcgttttgccaggtgaccacgttggtcaagaaatcacagccgaagccattaaggttcttaaagctatttctgatgttcgttccaatgtcaagttcgatttcgaaaatcatttaattggtggtgctgctatcgatgctacaggtgtcccacttccagatgaggcgctggaagcctccaagaaggttgatgccgttttgttaggtgctgtgggtggtcctaaatggggtaccggtagtgttagacctgaacaaggtttactaaaaatccgtaaagaacttcaattgtacgccaacttaagaccatgtaactttgcatccgactctcttttagacttatctccaatcaagccacaatttgctaaaggtactgacttcgttgttgtcagagaattagtgggaggtatttactttggtaagagaaaggaagacgatggtgatggtgtcgcttgggatagtgaacaatacaccgttccagaagtgcaaagaatcacaagaatggccgctttcatggccctacaacatgagccaccattgcctatttggtccttggataaagctaatgttttggcctcttcaagattatggagaaaaactgtggaggaaaccatcaagaacgaattccctacattgaaggttcaacatcaattgattgattctgccgccatgatcctagttaagaacccaacccacctaaatggtattataatcaccagcaacatgtttggtgatatcatctccgatgaagcctccgttatcccaggttccttgggtttgttgccatctgcgtccttggcctctttgccagacaagaacaccgcatttggtttgtacgaaccatgccacggttctgctccagatttgccaaagaataaggttgaccctatcgccactatcttgtctgctgcaatgatgttgaaattgtcattgaacttgcctgaagaaggtaaggccattgaagatgcagttaaaaaggttttggatgcaggtatcagaactggtgatttaggtggttccaacagtaccaccgaagtcggtgatgctgtcgccgaagaagttaagaaaatccttgcttaaaaagattctctttttttatgatatttgtacataaactttataaatgaaattcataatagaaacgacacgaaattacaaaatggaatatgttcatagggtagacgaaactatatacgcaatctacatacatttatcaagaaggagaaaaaggaggatagtaaaggaatacaggtaagcaaattgatactaatggctcaacgtgataaggaaaaagaattgcactttaacattaatattgacaaggaggagggcaccacacaaaaagttaggtgtaacagaaaatcatgaaactacgattcctaatttgatattggaggattttctctaaaaaaaaaaaaatacaacaaataaaaaacactcaatgacctgaccatttgatggagtttaagtcaataccttcttgaaccatttcccataatggtgaaagttccctcaagaattttactctgtcagaaacggccttacgacgtagtcgatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttaggacggatcgcttgcctgtaacttacacgcgcctcgtatcttttaatgatggaataatttgggaatttactctgtgtttatttatttttatgttttgtatttggattttagaaagtaaataaagaaggtagaagagttacggaatgaagaaaaaaaaataaacaaaggtttaaaaaatttcaacaaaaagcgtactttacatatatatttattagacaagaaaagcagattaaatagatatacattcgattaacgataagtaaaatgtaaaatcacaggattttcgtgtgtggtcttctacacagacaagatgaaacaattcggcattaatacctgagagcaggaagagcaagataaaaggtagtatttgttggcgatccccctagagtcttttacatcttcggaaaacaaaaactattttttctttaatttctttttttactttctatttttaatttatatatttatattaaaaaatttaaattataattatttttatagcacgtgatgaaaaggacccaggtggcacttttcggggaaatgtgcgcggaacccctatttgtttatttttctaaatacattcaaatatgtatccgctcatgagacaataaccctgataaatgcttcaataatctgcagctctggcccgtgtctcaaaatctctgatgttacattgcacaagataaaaatatatcatcatgaacaataaaactgtctgcttacataaacagtaatacaaggggtgttatgagccatattcaacgggaaacgtcttgctggaggccgcgattaaattccaacatggatgctgatttatatgggtataaatgggctcgcgataatgtcgggcaatcaggtgcgacaatctttcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccgcgggaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcatacgcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacactggcagagcattacgctgacttgacgggacggcgcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccaggggggaacgcctggtatctttatagtcctgtcgggtttcgccacctctgacttgagcgtcgatttttgtgatgctcgtcaggggggccgagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttacctcactcattaggcaccccaggctttacactttatgcttccggctcctatgttgtgtggaattgtgagcggataacaatttcacacaggaaacagctatgaccatgattacgccaagctcggaattaaccctcactaaagggaacaaaagctggtaccgatcccgagctttgcaaattaaagccttcgagcgtcccaaaaccttctcaagcaaggttttcagtataatgttacatgcgtacacgcgtctgtacagaaaaaaaagaaaaatttgaaatataaataacgttcttaatactaacataactataaaaaaataaatagggacctagacttcaggttgtctaactccttccttttcggttagagcggatgtggggggagggcgtgaatgtaagcgtgacataactaattacatgatatcgacaaaggaaaaggggcctgtttactcacaggcttttttcaagtaggtaattaagtcgtttctgtctttttccttcttcaacccaccaaaggccatcttggtacttttttttttttttttttttttttttttttttttttttttttttttttttttttttttttttttttttttttttttttttttttttttttttttcatagaaataatacagaagtagatgttgaattagattaaactgaagatatataatttattggaaaatacatagagctttttgttgatgcgcttaagcgatcaattcaacaacaccaccagcagctctgattttttcttcagccaacttggagacgaatctagctttgacgataactggaacatttggaattctacccttacccaagatcttaccgtaaccggctgccaaagtgtcaataactggagcagtttccttagaagcagatttcaagtattggtctctcttgtcttctgggatcaatgtccacaatttgtccaagttcaagactggcttccagaaatgagcttgttgcttgtggaagtatctcataccaaccttaccgaaataacctggatggtatttatccatgttaattctgtggtgatgttgaccaccggccatacctctaccaccggggtgctttctgtgcttaccgatacgacctttaccggctgagacgtgacctctgtgctttctagtcttagtgaatctggaaggcattcttgattagttggatgattgttctgggatttaatgcaaaaatcacttaagaaggaaaatcaacggagaaagcaaacgccatcttaaatatacgggatacagatgaaagggtttgaacctatctggaaaatagcattaaacaagcgaaaaactgcgaggaaaattgtttgcgtctctgcgggctattcacgcgccagaggaaaataggaaaaataacagggcattagaaaaataattttgattttggtaatgtgtgggtcctggtgtacagatgttacattggttacagtactcttgtttttgctgtgtttttcgatgaatctccaaaatggttgttagcacatggaagagtcaccgatgctaagttatctctatgtaagctacgtggcgtgacttttgatgaagccgcacaagagatacaggattggcaactgcaaatagaatctggggatcccccctcgagatccgggatcgaagaaatgatggtaaatgaaataggaaatcaaggagcatgaaggcaaaagacaaatataagggtcgaacgaaaaataaagtgaaaagtgttgatatgatgtatttggctttgcggcgccgaaaaaacgagtttacgcaattgcacaatcatgctgactctgtggcggacccgcgctcttgccggcccggcgataacgctgggcgtgaggctgtgcccggcggagttttttgcgcctgcattttccaaggtttaccctgcgctaaggggcgagattggagaagcaataagaatgccggttggggttgcgatgatgacgaccacgacaactggtgtcattatttaagttgccgaaagaacctgagtgcatttgcaacatgagtatactagaagaatgagccaagacttgcgagacgcgagtttgccggtggtgcgaacaatagagcgaccatgaccttgaaggtgagacgcgcataaccgctagagtactttgaagaggaaacagcaatagggttgctaccagtataaatagacaggtacatacaacactggaaatggttgtctgtttgagtacgctttcaattcatttgggtgtgcac

SEQ ID NO: 150 - DNA, 8923 bp, Artificial Sequence
  Description of Artificial Sequence: Synthetic pDEST22 polynucleotide
  gene (904)..(1248): GAL4 AD
  gene (1264)..(1388): attR1
  gene (1638)..(2297): CmR
  gene (2417)..(2501): inactivated ccdA
  gene (2639)..(2944): ccdB
  gene (2985)..(3109): attR2
  gene (3831)..(4318): f1 (f1 intergenic region)
  gene (4334)..(5176): TRP1
  gene (6110)..(7194): ampR
  gene (866)..(8344): pADH (yeast ADH promoter)
ttcatttgggtgtgcactttattatgttacaatatggaagggaactttacacttctcctatgcacatatattaattaaagtccaatgctagtagagaaggggggtaacacccctccgcgctcttttccgatttttttctaaaccgtggaatatttcggatatccttttgttgtttccgggtgtacaatatggacttcctcttttctggcaaccaaacccatacatcgggattcctataataccttcgttggtctccctaacatgtaggtggcggaggggagatatacaatagaacagataccagacaagacataatgggctaaacaagactacaccaattacactgcctcattgatggtggtacataacgaactaatactgtagccctagacttgatagccatcatcatatcgaagtttcactaccctttttccatttgccatctattgaagtaataataggcgcatgcaacttcttttctttttttttcttttctctctcccccgttgttgtctcaccatatccgcaatgacaaaaaaaatgatggaagacactaaaggaaaaaattaacgacaaagacagcaccaacagatgtcgttgttccagagctgatgaggggtatcttcgaacacacgaaactttttccttccttcattcacgcacactactctctaatgagcaacggtatacggccttccttccagttacttgaatttgaaataaaaaaagtttgccgctttgctatcaagtataaatagacctgcaattattaatcttttgtttcctcgtcattgttctcgttccctttcttccttgtttctttttctgcacaatatttcaagctataccaagcatacaatcaactccaagcttatgcccaagaagaagcggaaggtctcgagcggcgccaattttaatcaaagtgggaatattgctgatagctcattgtccttcactttcactaacagtagcaacggtccgaacctcataacaactcaaacaaattctcaagcgctttcacaaccaattgcctcctctaacgttcatgataacttcatgaataatgaaatcacggctagtaaaattgatgatggtaataattcaaaaccactgtcacctggttggacggaccaaactgcgtataacgcgtttggaatcactacagggatgtttaataccactacaatggatgatgtatataactatctattcgatgatgaagataccccaccaaacccaaaaaaagagggtgggtcgaatcaaacaagtttgtacaaaaaagctgaacgagaaacgtaaaatgatataaatatcaatatattaaattagattttgcataaaaaacagactacataatactgtaaaacacaacatatccagtcactatggcggccgctaagttggcagcatcacccgacgcactttgcgccgaataaatacctgtgacggaagatcacttcgcagaataaataaatcctggtgtccctgttgataccgggaagccctgggccaacttttggcgaaaatgagacgttgatcggcacgtaagaggttccaactttcaccataatgaaataagatcactaccgggcgtattttttgagttatcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtctgtgatggcttccatgtcggcagaatgcttaatgaattacaacagtactgcgatgagtggcagggcggggcgtaatctagaggatccggcttactaaaagccagataacagtatgcgtatttgcgcgctgatttttgcggtataagaatatatactgatatgtatacccgaagtatgtcaaaaagaggtgtgctatgaagcagcgtattacagtgacagttgacagcgacagctatcagttgctcaaggcatatatgatgtcaatatctccggtctggtaagcacaaccatgcagaatgaagcccgtcgtctgcgtgccgaacgctggaaagcggaaaatcaggaagggatggctgaggtcgcccggtttattgaaatgaacggctcttttgctgacgagaacagggactggtgaaatgcagtttaaggtttacacctataaaagagagagccgttatcgtctgtttgtggatgtacagagtgatattattgacacgcccgggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatataaatgtcaggctcccttatacacagccagtctgcaggtcgaccatagtgactggatatgttgtgttttacagtattatgtagtctgttttttatgcaaaatctaatttaatatattgatatttatatcattttacgtttctcgttcagctttcttgtacaaagtggtttgatggccgctaagtaagtaagacgtcgagctctaagtaagtaacggccgccaccgcggtggagctttggacttcttcgccagaggtttggtcaagtctccaatcaaggttgtcggcttgtctaccttgccagaaatttacgaaaagatggaaaagggtcaaatcgttggtagatacgttgttgacacttctaaataagcgaatttcttatgatttatgatttttattattaaataagttataaaaaaaataagtgtatacaaattttaaagtgactcttaggttttaaaacgaaaattcttattcttgagtaactctttcctgtaggtcaggttgctttctcaggtatagcatgaggtcgctcttattgaccacacctctaccggcatgccgagcaaatgcctgcaaatcgctccccatttcacccaattgtagatatgctaactccagcaatgagttgatgaatctcggtgtgtattttatgtcctcagaggacaatacctgttgtaatcgttcttccacacggatcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcctgatgcggtattttctccttacgcatctgtgcggtatttcacaccgcaggcaagtgcacaaacaatacttaaataaatactactcagtaataacctatttcttagcatttttgacgaaatttgctattttgttagagtcttttacaccatttgtctccacacctccgcttacatcaacaccaataacgccatttaatctaagcgcatcaccaacattttctggcgtcagtccaccagctaacataaaatgtaagctttcggggctctcttgccttccaacccagtcagaaatcgagttccaatccaaaagttcacctgtcccacctgcttctgaatcaaacaagggaataaacgaatgaggtttctgtgaagctgcactgagtagtatgttgcagtcttttggaaatacgagtcttttaataactggcaaaccgaggaactcttggtattcttgccacgactcatctccatgcagttggacgatatcaatgccgtaatcattgaccagagccaaaacatcctccttaggttgattacgaaacacgccaaccaagtatttcggagtgcctgaactatttttatatgcttttacaagacttgaaattttccttgcaataaccgggtcaattgttctctttctattgggcacacatataatacccagcaagtcagcatcggaatctagagcacattctgcggcctctgtgctctgcaagccgcaaactttcaccaatggaccagaactacctgtgaaattaataacagacatactccaagctgcctttgtgtgcttaatcacgtatactcacgtgctcaatagtcaccaatgccctccctcttggccctctccttttcttttttcgaccgaattaattcttaatcggcaaaaaaagaaaagctccggatcaagattgtacgtaaggtgacaagctatttttcaataaagaatatcttccactactgccatctggcgtcataactgcaaagtacacatatattacgatgctgtctattaaatgcttcctatattatatatatagtaatgtcgtttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttaggacggatcgcttgcctgtaacttacacgcgcctcgtatcttttaatgatggaataatttgggaatttactctgtgtttatttatttttatgttttgtatttggattttagaaagtaaataaagaaggtagaagagttacggaatgaagaaaaaaaaataaacaaaggtttaaaaaatttcaacaaaaagcgtactttacatatatatttattagacaagaaaagcagattaaatagatatacattcgattaacgataagtaaaatgtaaaatcacaggattttcgtgtgtggtcttctacacagacaagatgaaacaattcggcattaatacctgagagcaggaagagcaagataaaaggtagtatttgttggcgatccccctagagtcttttacatcttcggaaaacaaaaactattttttctttaatttctttttttactttctatttttaatttatatatttatattaaaaaatttaaattataattatttttatagcacgtgatgaaaaggacccaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgctttttttcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacgggcagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccaggggggaacgcctggtatctttatagtcctgtcgggtttcgccacctctgacttgagcgtcgatttttgtgatgctcgtcaggggggccgagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttacctcactcattaggcaccccaggctttacactttatgcttccggctcctatgttgtgtggaattgtgagcggataacaatttcacacaggaaacagctatgaccatgattacgccaagctcggaattaaccctcactaaagggaacaaaagctgggtaccgggccccccctcgagatccgggatcgaagaaatgatggtaaatgaaataggaaatcaaggagcatgaaggcaaaagacaaatataagggtcgaacgaaaaataaagtgaaaagtgttgatatgatgtatttggctttgcggcgccgaaaaaacgagtttacgcaattgcacaatcatgctgactctgtggcggacccgcgctcttgccggcccggcgataacgctgggcgtgaggctgtgcccggcggagttttttgcgcctgcattttccaaggtttaccctgcgctaaggggcgagattggagaagcaataagaatgccggttggggttgcgatgatgacgaccacgacaactggtgtcattatttaagttgccgaaagaacctgagtgcatttgcaacatgagtatactagaagaatgagccaagacttgcgagacgcgagtttgccggtggtgcgaacaatagagcgaccatgaccttgaaggtgagacgcgcataaccgctagagtactttgaagaggaaacagcaatagggttgctaccagtataaatagacaggtacatacaacactggaaatggttgtctgtttgagtacgctttcaa

SEQ ID NO: 151 - DNA, 6264 bp, Artificial Sequence
  Description of Artificial Sequence: Synthetic pDEST23 polynucleotide
  gene (161)..(285): attR1
  gene (394)..(1053): CmR
  gene (1173)..(1257): inactivated ccdA
  gene (1395)..(1700): ccdB
  gene (1741)..(1865): attR2
  gene (1883)..(1911): his6
  gene (2574)..(3434): ampR
  gene (3583)..(4222): ori
tcttccccatcggtgatgtcggcgatataggcgccagcaaccgcacctgtggcgccggtgatgccggccacgatgcgtccggcgtagaggatcgagatctcgatcccgcgaaattaatacgactcactatagggagaccacaacggtttccctctagatcacaagtttgtacaaaaaagctgaacgagaaacgtaaaatgatataaatatcaatatattaaattagattttgcataaaaaacagactacataatactgtaaaacacaacatatccagtcactatggcggccgcattaggcaccccaggctttacactttatgcttccggctcgtataatgtgtggattttgagttaggatccggcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtctgtgatggcttccatgtcggcagaatgcttaatgaattacaacagtactgcgatgagtggcagggcggggcgtaaacgcgtggatccggcttactaaaagccagataacagtatgcgtatttgcgcgctgatttttgcggtataagaatatatactgatatgtatacccgaagtatgtcaaaaagaggtgtgctatgaagcagcgtattacagtgacagttgacagcgacagctatcagttgctcaaggcatatatgatgtcaatatctccggtctggtaagcacaaccatgcagaatgaagcccgtcgtctgcgtgccgaacgctggaaagcggaaaatcaggaagggatggctgaggtcgcccggtttattgaaatgaacggctcttttgctgacgagaacagggactggtgaaatgcagtttaaggtttacacctataaaagagagagccgttatcgtctgtttgtggatgtacagagtgatattattgacacgcccgggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatataaatgtcaggctcccttatacacagccagtctgcaggtcgaccatagtgactggatatgttgtgttttacagtattatgtagtctgttttttatgcaaaatctaatttaatatattgatatttatatcattttacgtttctcgttcagctttcttgtacaaagtggtgattatgtcgtactaccatcaccatcaccatcacctcgatgagcaataactagcataaccccttggggcctctaaacgggtcttgaggggttttttgctgaaaggaggaactatatccggatatccacaggacgggtgtggtcgccatgatcgcgtagtcgatagtggctccaagtagcgaagcgagcaggactgggcggcggccaaagcggtcggacagtgctccgagaacgggtgcgcatagaaattgcatcaacgcatatagcgctagcagcacgccatagtgactggcgatgctgtcggaatggacgatatcccgcaagaggcccggcagtaccggcataaccaagcctatgcctacagcatccagggtgacggtgccgaggatgacgatgagcgcattgttagatttcatacacggtgcctgactgcgttagcaatttaactgtgataaactaccgcattaaagcttatcgatgataagctgtcaaacatgagaattcttgaagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagctgcggtaaagctcatcagcgtggtcgtgaagcgattcacagatgtctgcctgttcatccgcgtccagctcgttgagtttctccagaagcgttaatgtctggcttctgataaagcgggccatgttaagggcggttttttcctgtttggtcactgatgcctccgtgtaagggggatttctgttcatgggggtaatgataccgatgaaacgagagaggatgctcacgatacgggttactgatgatgaacatgcccggttactggaacgttgtgagggtaaacaactggcggtatggatgcggcgggaccagagaaaaatcactcagggtcaatgccagcgcttcgttaatacagatgtaggtgttccacagggtagccagcagcatcctgcgatgcagatccggaacataatggtgcagggcgctgacttccgcgtttccagactttacgaaacacggaaaccgaagaccattcatgttgttgctcaggtcgcagacgttttgcagcagcagtcgcttcacgttcgctcgcgtatcggtgattcattctgctaaccagtaaggcaaccccgccagcctagccgggtcctcaacgacaggagcacgatcatgcgcacccgtggccaggacccaacgctgcccgagatgcgccgcgtgcggctgctggagatggcggacgcgatggatatgttctgccaagggttggtttgcgcattcacagttctccgcaagaattgattggctccaattcttggagtggtgaatccgttagcgaggtgccgccggcttccattcaggtcgaggtggcccggctccatgcaccgcgacgcaacgcggggaggcagacaaggtatagggcggcgcctacaatccatgccaacccgttccatgtgctcgccgaggcggcataaatcgccgtgacgatcagcggtccagtgatcgaagttaggctggtaagagccgcgagcgatccttgaagctgtccctgatggtcgtcatctacctgcctggacagcatggcctgcaacgcgggcatcccgatgccgccggaagcgagaagaatcataatggggaaggccatccagcctcgcgtcgcgaacgccagcaagacgtagcccagcgcgtcggccgccatgccggcgataatggcctgcttctcgccgaaacgtttggtggcgggaccagtgacgaaggcttgagcgagggcgtgcaagattccgaataccgcaagcgacaggccgatcatcgtcgcgctccagcgaaagcggtcctcgccgaaaatgacccagagcgctgccggcacctgtcctacgagttgcatgataaagaagacagtcataagtgcggcgacgatagtcatgccccgcgcccaccggaaggagctgactgggttgaaggctctcaagggcatcggtcgatcgacgctctcccttatgcgactcctgcattaggaagcagcccagtagtaggttgaggccgttgagcaccgccgccgcaaggaatggtgcatgcaaggagatggcgcccaacagtcccccggccacggggcctgccaccatacccacgccgaaacaagcgctcatgagcccgaagtggcgagcccga

SEQ ID NO: 152 - DNA, 6961 bp, Artificial Sequence
  Description of Artificial Sequence: Synthetic pDEST24 polynucleotide
  gene (71)..(195): attR1
  gene (304)..(963): CmR
  gene (1083)..(1167): inactivated ccdA
  gene (1305)..(1610): ccdB
  gene (1651)..(1775): attR2
  gene (1783)..(2451): GST
  gene (3181)..(4041): ampR
  gene (4190)..(4829): ori
atcgagatctcgatcccgcgaaattaatacgactcactatagggagaccacaacggtttccctctagatcacaagtttgtacaaaaaagctgaacgagaaacgtaaaatgatataaatatcaatatattaaattagattttgcataaaaaacagactacataatactgtaaaacacaacatatccagtcactatggcggccgcattaggcaccccaggctttacactttatgcttccggctcgtataatgtgtggattttgagttaggatccggcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtctgtgatggcttccatgtcggcagaatgcttaatgaattacaacagtactgcgatgagtggcagggcggggcgtaaacgcgtggatccggcttactaaaagccagataacagtatgcgtatttgcgcgctgatttttgcggtataagaatatatactgatatgtatacccgaagtatgtcaaaaagaggtgtgctatgaagcagcgtattacagtgacagttgacagcgacagctatcagttgctcaaggcatatatgatgtcaatatctccggtctggtaagcacaaccatgcagaatgaagcccgtcgtctgcgtgccgaacgctggaaagcggaaaatcaggaagggatggctgaggtcgcccggtttattgaaatgaacggctcttttgctgacgagaacagggactggtgaaatgcagtttaaggtttacacctataaaagagagagccgttatcgtctgtttgtggatgtacagagtgatattattgacacgcccgggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatataaatgtcaggctcccttatacacagccagtctgcaggtcgaccatagtgactggatatgttgtgttttacagtattatgtagtctgttttttatgcaaaatctaatttaatatattgatatttatatcattttacgtttctcgttcagctttcttgtacaaagtggtgattatgtcccctatactaggttattggaaaattaagggccttgtgcaacccactcgacttcttttggaatatcttgaagaaaaatatgaagagcatttgtatgagcgcgatgaaggtgataaatggcgaaacaaaaagtttgaattgggtttggagtttcccaatcttccttattatattgatggtgatgttaaattaacacagtctatggccatcatacgttatatagctgacaagcacaacatgttgggtggttgtccaaaagagcgtgcagagatttcaatgcttgaaggagcggttttggatattagatacggtgtttcgagaattgcatatagtaaagactttgaaactctcaaagttgattttcttagcaagctacctgaaatgctgaaaatgttcgaagatcgtttatgtcataaaacatatttaaatggtgatcatgtaacccatcctgacttcatgttgtatgacgctcttgatgttgttttatacatggacccaatgtgcctggatgcgttcccaaaattagtttgttttaaaaaacgtattgaagctatcccacaaattgataagtacttgaaatccagcaagtatatagcatggcctttgcagggctggcaagccacgtttggtggtggcgaccatcctccaaaatcggatctggttccgcgtccatggggatccggctgctaacaaagcccgaaaggaagctgagttggctgctgccaccgctgagcaataactagcataaccccttggggcctctaaacgggtcttgaggggttttttgctgaaaggaggaactatatccggatatccacaggacgggtgtggtcgccatgatcgcgtagtcgatagtggctccaagtagcgaagcgagcaggactgggcggcggccaaagcggtcggacagtgctccgagaacgggtgcgcatagaaattgcatcaacgcatatagcgctagcagcacgccatagtgactggcgatgctgtcggaatggacgatatcccgcaagaggcccggcagtaccggcataaccaagcctatgcctacagcatccagggtgacggtgccgaggatgacgatgagcgcattgttagatttcatacacggtgcctgactgcgttagcaatttaactgtgataaactaccgcattaaagcttatcgatgataagctgtcaaacatgagaattcttgaagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagctgcggtaaagctcatcagcgtggtcgtgaagcgattcacagatgtctgcctgttcatccgcgtccagctcgttgagtttctccagaagcgttaatgtctggcttctgataaagcgggccatgttaagggcggttttttcctgtttggtcactgatgcctccgtgtaagggggatttctgttcatgggggtaatgataccgatgaaacgagagaggatgctcacgatacgggttactgatgatgaacatgcccggttactggaacgttgtgagggtaaacaactggcggtatggatgcggcgggaccagagaaaaatcactcagggtcaatgccagcgcttcgttaatacagatgtaggtgttccacagggtagccagcagcatcctgcgatgcagatccggaacataatggtgcagggcgctgacttccgcgtttccagactttacgaaacacggaaaccgaagaccattcatgttgttgctcaggtcgcagacgttttgcagcagcagtcgcttcacgttcgctcgcgtatcggtgattcattctgctaaccagtaaggcaaccccgccagcctagccgggtcctcaacgacaggagcacgatcatgcgcacccgtggccaggacccaacgctgcccgagatgcgccgcgtgcggctgctggagatggcggacgcgatggatatgttctgccaagggttggtttgcgcattcacagttctccgcaagaattgattggctccaattcttggagtggtgaatccgttagcgaggtgccgccggcttccattcaggtcgaggtggcccggctccatgcaccgcgacgcaacgcggggaggcagacaaggtatagggcggcgcctacaatccatgccaacccgttccatgtgctcgccgaggcggcataaatcgccgtgacgatcagcggtccagtgatcgaagttaggctggtaagagccgcgagcgatccttgaagctgtccctgatggtcgtcatctacctgcctggacagcatggcctgcaacgcgggcatcccgatgccgccggaagcgagaagaatcataatggggaaggccatccagcctcgcgtcgcgaacgccagcaagacgtagcccagcgcgtcggccgccatgccggcgataatggcctgcttctcgccgaaacgtttggtggcgggaccagtgacgaaggcttgagcgagggcgtgcaagattccgaataccgcaagcgacaggccgatcatcgtcgcgctccagcgaaagcggtcctcgccgaaaatgacccagagcgctgccggcacctgtcctacgagttgcatgataaagaagacagtcataagtgcggcgacgatagtcatgccccgcgcccaccggaaggagctgactgggttgaaggctctcaagggcatcggtcgatcgacgctctcccttatgcgactcctgcattaggaagcagcccagtagtaggttgaggccgttgagcaccgccgccgcaaggaatggtgcatgcaaggagatggcgcccaacagtcccccggccacggggcctgccaccatacccacgccgaaacaagcgctcatgagcccgaagtggcgagcccgatcttccccatcggtgatgtcggcgatataggcgccagcaaccgcacctgtggcgccggtgatgccggccacgatgcgtccggcgtagagg

SEQ ID NO: 153 - DNA, 6652 bp, Artificial Sequence
  Description of Artificial Sequence: Synthetic pDEST25 polynucleotide
  gene (720)..(844): attR1
  gene (953)..(1612): CmR
  gene (1732)..(1816): inactivated ccdA
  gene (1954)..(2259): ccdB
  gene (2300)..(2424): attR2
  gene (2432)..(2794): trx
ccggaagcgagaagaatcataatggggaaggccatccagcctcgcgtcgcgaacgccagcaagacgtagcccagcgcgtcggccgccatgccggcgataatggcctgcttctcgccgaaacgtttggtggcgggaccagtgacgaaggcttgagcgagggcgtgcaagattccgaataccgcaagcgacaggccgatcatcgtcgcgctccagcgaaagcggtcctcgccgaaaatgacccagagcgctgccggcacctgtcctacgagttgcatgataaagaagacagtcataagtgcggcgacgatagtcatgccccgcgcccaccggaaggagctgactgggttgaaggctctcaagggcatcggtcgatcgacgctctcccttatgcgactcctgcattaggaagcagcccagtagtaggttgaggccgttgagcaccgccgccgcaaggaatggtgcatgcaaggagatggcgcccaacagtcccccggccacggggcctgccaccatacccacgccgaaacaagcgctcatgagcccgaagtggcgagcccgatcttccccatcggtgatgtcggcgatataggcgccagcaaccgcacctgtggcgccggtgatgccggccacgatgcgtccggcgtagaggatcgagatctcgatcccgcgaaattaatacgactcactatagggagaccacaacggtttccctctagatcacaagtttgtacaaaaaagctgaacgagaaacgtaaaatgatataaatatcaatatattaaattagattttgcataaaaaacagactacataatactgtaaaacacaacatatccagtcactatggcggccgcattaggcaccccaggctttacactttatgcttccggctcgtataatgtgtggattttgagttaggatccggcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtctgtgatggcttccatgtcggcagaatgcttaatgaattacaacagtactgcgatgagtggcagggcggggcgtaaacgcgtggatccggcttactaaaagccagataacagtatgcgtatttgcgcgctgatttttgcggtataagaatatatactgatatgtatacccgaagtatgtcaaaaagaggtgtgctatgaagcagcgtattacagtgacagttgacagcgacagctatcagttgctcaaggcatatatgatgtcaatatctccggtctggtaagcacaaccatgcagaatgaagcccgtcgtctgcgtgccgaacgctggaaagcggaaaatcaggaagggatggctgaggtcgcccggtttattgaaatgaacggctcttttgctgacgagaacagggactggtgaaatgcagtttaaggtttacacctataaaagagagagccgttatcgtctgtttgtggatgtacagagtgatattattgacacgcccgggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatataaatgtcaggctcccttatacacagccagtctgcaggtcgaccatagtgactggatatgttgtgttttacagtattatgtagtctgttttttatgcaaaatctaatttaatatattgatatttatatcattttacgtttctcgttcagctttcttgtacaaagtggtgattatgagcgataaaattattcacctgactgacgacagttttgacacggatgtactcaaagcggacggggcgatcctcgtcgatttctgggcagagtggtgcggtccgtgcaaaatgatcgccccgattctggatgaaatcgctgacgaatatcagggcaaactgaccgttgcaaaactgaacatcgatcaaaaccctggcactgcgccgaaatatggcatccgtggtatcccgactctgctgctgttcaaaaacggtgaagtggcggcaaccaaagtgggtgcactgtctaaaggtcagttgaaagagttcctcgacgctaacctggccggttctggttctggtgatgacgatgacaaggtacccggggatcgatccggctgctaacaaagcccgaaaggaagctgagttggctgctgccaccgctgagcaataactagcataaccccttggggcctctaaacgggtcttgaggggttttttgctgaaaggaggaactatatccggatatccacaggacgggtgtggtcgccatgatcgcgtagtcgatagtggctccaagtagcgaagcgagcaggactgggcggcggccaaagcggtcggacagtgctccgagaacgggtgcgcatagaaattgcatcaacgcatatagcgctagcagcacgccatagtgactggcgatgctgtcggaatggacgatatcccgcaagaggcccggcagtaccggcataaccaagcctatgcctacagcatccagggtgacggtgccgaggatgacgatgagcgcattgttagatttcatacacggtgcctgactgcgttagcaatttaactgtgataaactaccgcattaaagcttatcgatgataagctgtcaaacatgagaattcttgaagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagctgcggtaaagctcatcagcgtggtcgtgaagcgattcacagatgtctgcctgttcatccgcgtccagctcgttgagtttctccagaagcgttaatgtctggcttctgataaagcgggccatgttaagggcggttttttcctgtttggtcactgatgcctccgtgtaagggggatttctgttcatgggggtaatgataccgatgaaacgagagaggatgctcacgatacgggttactgatgatgaacatgcccggttactggaacgttgtgagggtaaacaactggcggtatggatgcggcgggaccagagaaaaatcactcagggtcaatgccagcgcttcgttaatacagatgtaggtgttccacagggtagccagcagcatcctgcgatgcagatccggaacataatggtgcagggcgctgacttccgcgtttccagactttacgaaacacggaaaccgaagaccattcatgttgttgctcaggtcgcagacgttttgcagcagcagtcgcttcacgttcgctcgcgtatcggtgattcattctgctaaccagtaaggcaaccccgccagcctagccgggtcctcaacgacaggagcacgatcatgcgcacccgtggccaggacccaacgctgcccgagatgcgccgcgtgcggctgctggagatggcggacgcgatggatatgttctgccaagggttggtttgcgcattcacagttctccgcaagaattgattggctccaattcttggagtggtgaatccgttagcgaggtgccgccggcttccattcaggtcgaggtggcccggctccatgcaccgcgacgcaacgcggggaggcagacaaggtatagggcggcgcctacaatccatgccaacccgttccatgtgctcgccgaggcggcataaatcgccgtgacgatcagcggtccagtgatcgaagttaggctggtaagagccgcgagcgatccttgaagctgtccctgatggtcgtcatctacctgcctggacagcatggcctgcaacgcgggcatcccgatgccg

SEQ ID NO: 154 - DNA, 7481 bp, Artificial Sequence
  Description of Artificial Sequence: Synthetic pDEST26 polynucleotide
  gene (492)..(509): his6
  gene (519)..(619): attR1
  gene (752)..(1411): CmR
  gene (1531)..(1615): inactivated ccdA
  gene (1753)..(2058): ccdB
  gene (2099)..(2223): attR2
  gene (2409)..(2771): SV40 polyA
  gene (2966)..(3421): f1 intergenic region
  gene (3485)..(3903): SV40 promoter
  gene (3948)..(4742): neo
  gene (4806)..(4854): polyA
  gene (5265)..(6125): Apr
  gene (5274)..(6913): ori
  gene (385)..(7344): CMV promoter
gtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccggactctagcctaggccgcggaccatggcgtactaccatcaccatcaccatcactctagatcaacaagtttgtacaaaaaagctgaacgagaaacgtaaaatgatataaatatcaatatattaaattagattttgcataaaaaacagactacataatactgtaaaacacaacatatccagtcactatggcggccgcattaggcaccccaggctttacactttatgcttccggctcgtataatgtgtggattttgagttaggatccggcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtctgtgatggcttccatgtcggcagaatgcttaatgaattacaacagtactgcgatgagtggcagggcggggcgtaaagatctggatccggcttactaaaagccagataacagtatgcgtatttgcgcgctgatttttgcggtataagaatatatactgatatgtatacccgaagtatgtcaaaaagaggtgtgctatgaagcagcgtattacagtgacagttgacagcgacagctatcagttgctcaaggcatatatgatgtcaatatctccggtctggtaagcacaaccatgcagaatgaagcccgtcgtctgcgtgccgaacgctggaaagcggaaaatcaggaagggatggctgaggtcgcccggtttattgaaatgaacggctcttttgctgacgagaacagggactggtgaaatgcagtttaaggtttacacctataaaagagagagccgttatcgtctgtttgtggatgtacagagtgatattattgacacgcccgggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatataaatgtcaggctcccttatacacagccagtctgcaggtcgaccatagtgactggatatgttgtgttttacagtattatgtagtctgttttttatgcaaaatctaatttaatatattgatatttatatcattttacgtttctcgttcagctttcttgtacaaagtggttgatcgcgtgcatgcgacgtcatagctctctccctatagtgagtcgtattataagctaggcactggccgtcgttttacaacgtcgtgactgggaaaactgctagcttgggatctttgtgaaggaaccttacttctgtggtgtgacataattggacaaactacctacagagatttaaagctctaaggtaaatataaaatttttaagtgtataatgtgttaaactagctgcatatgcttgctgcttgagagttttgcttactgagtatgatttatgaaaatattatacacaggagctagtgattctaattgtttgtgtattttagattcacagtcccaaggctcatttcaggcccctcagtcctcacagtctgttcatgatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggatcgatcctgcattaatgaatcggccaacgcgcggggagaggcggtttgcgtattggctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaatatttaacgcgaattttaacaaaatattaacgtttacaatttcgcctgatgcggtattttctccttacgcatctgtgcggtatttcacaccgcatacgcggatctgcgcagcaccatggcctgaaataacctctgaaagaggaacttggttaggtaccttctgaggcggaaagaaccagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagcttgattcttctgacacaacagtctcgaacttaaggctagagccaccatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgatggccgcaataaaatatctttattttcattacatctgtgtgttggttttttgtgtgaatcgatagcgataaggatccgcgtatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagagcttgcaattcgcgcgtttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtagtacgaggccctttcactcattagatgcatgtcgttacataacttacggtaaatggcccgcctggctgaccgcccaacgacccccgcccattgacgtcaataatgacgtatgttcccatagtaacgccaatagggactttccattgacgtcaatgggtggagtatttacg

SEQ ID NO: 155 - DNA, 8123 bp, Artificial Sequence
  Description of Artificial Sequence: Synthetic pDEST27 polynucleotide
  gene (130)..(793): GST
  gene (803)..(927): attR1
  gene (1036)..(1695): CmR
  gene (1815)..(1899): inactivated ccdA
  gene (2037)..(2342): ccdB
  gene (2383)..(2507): attR2
  gene (2693)..(3055): SV40 polyA
  gene (3250)..(3705): f1 intergenic region
  gene (3769)..(4187): SV40 promoter
  gene (4232)..(5026): neo
  gene (5090)..(5138): polyA
  gene (5549)..(6409): Apr
  gene (6558)..(7197): ori
  gene (27)..(7628): CMV promoter
ataagcagagctcgtttagtgaaccgtcagatcgcctggagacgccatccacgctgttttgacctccatagaagacaccgggaccgatccagcctccggactctagcctaggccgcggaccatggcccctatactaggttattggaaaattaagggccttgtgcaacccactcgacttcttttggaatatcttgaagaaaaatatgaagagcatttgtatgagcgcgatgaaggtgataaatggcgaaacaaaaagtttgaattgggtttggagtttcccaatcttccttattatattgatggtgatgttaaattaacacagtctatggccatcatacgttatatagctgacaagcacaacatgttgggtggttgtccaaaagagcgtgcagagatttcaatgcttgaaggagcggttttggatattagatacggtgtttcgagaattgcatatagtaaagactttgaaactctcaaagttgattttcttagcaagctacctgaaatgctgaaaatgttcgaagatcgtttatgtcataaaacatatttaaatggtgatcatgtaacccatcctgacttcatgttgtatgacgctcttgatgttgttttatacatggacccaatgtgcctggatgcgttcccaaaattagtttgttttaaaaaacgtattgaagctatcccacaaattgataagtacttgaaatccagcaagtatatagcatggcctttgcagggctggcaagccacgtttggtggtggcgaccatcctccaaaatcggatctggttccgcgttctagatcaacaagtttgtacaaaaaagctgaacgagaaacgtaaaatgatataaatatcaatatattaaattagattttgcataaaaaacagactacataatactgtaaaacacaacatatccagtcactatggcggccgcattaggcaccccaggctttacactttatgcttccggctcgtataatgtgtggattttgagttaggatccggcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtctgtgatggcttccatgtcggcagaatgcttaatgaattacaacagtactgcgatgagtggcagggcggggcgtaaagatctggatccggcttactaaaagccagataacagtatgcgtatttgcgcgctgatttttgcggtataagaatatatactgatatgtatacccgaagtatgtcaaaaagaggtgtgctatgaagcagcgtattacagtgacagttgacagcgacagctatcagttgctcaaggcatatatgatgtcaatatctccggtctggtaagcacaaccatgcagaatgaagcccgtcgtctgcgtgccgaacgctggaaagcggaaaatcaggaagggatggctgaggtcgcccggtttattgaaatgaacggctcttttgctgacgagaacagggactggtgaaatgcagtttaaggtttacacctataaaagagagagccgttatcgtctgtttgtggatgtacagagtgatattattgacacgcccgggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatataaatgtcaggctcccttatacacagccagtctgcaggtcgaccatagtgactggatatgttgtgttttacagtattatgtagtctgttttttatgcaaaatctaatttaatatattgatatttatatcattttacgtttctcgttcagctttcttgtacaaagtggttgatcgcgtgcatgcgacgtcatagctctctccctatagtgagtcgtattataagctaggcactggccgtcgttttacaacgtcgtgactgggaaaactgctagcttgggatctttgtgaaggaaccttacttctgtggtgtgacataattggacaaactacctacagagatttaaagctctaaggtaaatataaaatttttaagtgtataatgtgttaaactagctgcatatgcttgctgcttgagagttttgcttactgagtatgatttatgaaaatattatacacaggagctagtgattctaattgtttgtgtattttagattcacagtcccaaggctcatttcaggcccctcagtcctcacagtctgttcatgatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggatcgatcctgcattaatgaatcggccaacgcgcggggagaggcggtttgcgtattggctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaatatttaacgcgaattttaacaaaatattaacgtttacaatttcgcctgatgcggtattttctccttacgcatctgtgcggtatttcacaccgcatacgcggatctgcgcagcaccatggcctgaaataacctctgaaagaggaacttggttaggtaccttctgaggcggaaagaaccagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagcttgattcttctgacacaacagtctcgaacttaaggctagagccaccatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgatggccgcaataaaatatctttattttcattacatctgtgtgttggttttttgtgtgaatcgatagcgataaggatccgcgtatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagagcttgcaattcgcgcgtttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtagtacgaggccctttcactcattagatgcatgtcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctat

SEQ ID NO: 156 - DNA, 4396 bp, Artificial Sequence
  Description of Artificial Sequence: Synthetic pEXP501 polynucleotide
ccattcgccattcaggctgcgcaactgttgggaagggcgatcggtgcgggcctcttcgctattacgccagccaatacgcaaaccgcctctccccgcgcgttggccgattcattaatgcaggatcgatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtatggctgattatgatcatgaacagactgtgaggactgaggggcctgaaatgagccttgggactgtgaatctaaaatacacaaacaattagaatcactagctcctgtgtataatattttcataaatcatactcagtaagcaaaactctcaagcagcaagcatatgcagctagtttaacacattatacacttaaaaattttatatttaccttagagctttaaatctctgtaggtagtttgtccaattatgtcacaccacagaagtaaggttccttcacaaagatcccaagctagcagttttcccagtcacgacgttgtaaaacgacggccagtgcctagcttataatacgactcactatagggaccactttgtacaagaaagctgggtacgcgtaagcttgggcccctcgagggatcctctagagcggccgccgactagtgagctcgtcgacgatatcccgggaattccggaccggtaccagcctgcttttttgtacaaacttgttctatagtgtcacctaaataggcctaatggtcatagctgtttcctgtgtgaaattgttatccgctccgcggcctaggctagagtccggaggctggatcggtcccggtgtcttctatggaggtcaaaacagcgtggatggcgtctccaggcgatctgacggttcactaaacgagctctgcttatatagacctcccaccgtacacgcctaccgcccatttgcgtcaatggggcggagttgttacgacattttggaaagtcccgttgattttggtgccaaaacaaactcccattgacgtcaatggggtggagacttggaaatccccgtgagtcaaaccgctatccacgcccattgatgtactgccaaaaccgcatcaccatggtaatagcgatgactaatacgtagatgtactgccaagtaggaaagtcccataaggtcatgtactgggcataatgccaggcgggccatttaccgtcattgacgtcaatagggggcgtacttggcatatgatacacttgatgtactgccaagtgggcagtttaccgtaaatactccacccattgacgtcaatggaaagtccctattggcgttactatgggaacatacgtcattattgacgtcaatgggcgggggtcgttgggcggtcagccaggcgggccatttaccgtaagttatgtaacgacatgcatctaatgagtgaaagggcctcgtactacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaacgcgcgaattgcaagctctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgccataacttcgtatagcatacattatacgaagttatggcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgccaggggtgggcacacatatttgataccagcgatccctacacagcacataattcaatgcgacttccctctatcgcacatcttagacctttattctccctccagcacacatcgaagctgccgagcaagccgttctcaccagtccaagacctggcatgagcggatacatatttgaatgtatttagaaaaataaacaaataggggttccgcgcacatttccccgaaaagtgccacctgaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtc

SEQ ID NO: 157 - DNA, 4470 bp, Artificial Sequence
  Description of Artificial Sequence: Synthetic pDONR201 polynucleotide
  gene (29)..(260): attP1
  gene (656)..(961): ccdB
  gene (1099)..(1184): ccdA
  gene (1303)..(1962): CmR
  gene (2210)..(2442): attP2
  gene (2565)..(3374): Kmr
  gene (3495)..(4134): ori
gttaacgctagcatggatctcgggccccaaataatgattttattttgactgatagtgacctgttcgttgcaacaaattgatgagcaatgcttttttataatgccaactttgtacaaaaaagctgaacgagaaacgtaaaatgatataaatatcaatatattaaattagattttgcataaaaaacagactacataatactgtaaaacacaacatatccagtcactatgaatcaactacttagatggtattagtgacctgtagtcgaccgacagccttccaaatgttcttcgggtgatgctgccaacttagtcgaccgacagccttccaaatgttcttctcaaacggaatcgtcgtatccagcctactcgctattgtcctcaatgccgtattaaatcataaaaagaaataagaaaaagaggtgcgagcctcttttttgtgtgacaaaataaaaacatctacctattcatatacgctagtgtcatagtcctgaaaatcatctgcatcaagaacaatttcacaactcttatacttttctcttacaagtcgttcggcttcatctggattttcagcctctatacttactaaacgtgataaagtttctgtaatttctactgtatcgacctgcagactggctgtgtataagggagcctgacatttatattccccagaacatcaggttaatggcgtttttgatgtcattttcgcggtggctgagatcagccacttcttccccgataacggagaccggcacactggccatatcggtggtcatcatgcgccagctttcatccccgatatgcaccaccgggtaaagttcacgggagactttatctgacagcagacgtgcactggccagggggatcaccatccgtcgcccgggcgtgtcaataatatcactctgtacatccacaaacagacgataacggctctctcttttataggtgtaaaccttaaactgcatttcaccagtccctgttctcgtcagcaaaagagccgttcatttcaataaaccgggcgacctcagccatcccttcctgattttccgctttccagcgttcggcacgcagacgacgggcttcattctgcatggttgtgcttaccagaccggagatattgacatcatatatgccttgagcaactgatagctgtcgctgtcaactgtcactgtaatacgctgcttcatagcacacctctttttgacatacttcgggtatacatatcagtatatattcttataccgcaaaaatcagcgcgcaaatacgcatactgttatctggcttttagtaagccggatccacgcgattacgccccgccctgccactcatcgcagtactgttgtaattcattaagcattctgccgacatggaagccatcacagacggcatgatgaacctgaatcgccagcggcatcagcaccttgtcgccttgcgtataatatttgcccatggtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaattccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccgatcaacgtctcattttcgccaaaagttggcccagggcttcccggtatcaacagggacaccaggatttatttattctgcgaagtgatcttccgtcacaggtatttattcggcgcaaagtgcgtcgggtgatgctgccaacttagtcgactacaggtcactaataccatctaagtagttgattcatagtgactggatatgttgtgttttacagtattatgtagtctgttttttatgcaaaatctaatttaatatattgatatttatatcattttacgtttctcgttcagctttcttgtacaaagttggcattataagaaagcattgcttatcaatttgttgcaacgaacaggtcactatcagtcaaaataaaatcattatttgccatccagctgcagctctggcccgtgtctcaaaatctctgatgttacattgcacaagataaaaatatatcatcatgaacaataaaactgtctgcttacataaacagtaatacaaggggtgttatgagccatattcaacgggaaacgtcgaggccgcgattaaattccaacatggatgctgatttatatgggtataaatgggctcgcgataatgtcgggcaatcaggtgcgacaatctatcgcttgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggaaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacactggcagagcattacgctgacttgacgggacggcgcaagctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgctagccaggaagagtttgtagaaacgcaaaaaggccatccgtcaggatggccttctgcttagtttgatgcctggcagtttatggcgggcgtcctgcccgccaccctccgggccgttgcttcacaacgttcaaatccgctcccggcggatttgtcctactcaggagagcgttcaccgacaaacaacagataaaacgaaaggcccagtcttccgactgagcctttcgttttatttgatgcctggcagttccctactctcgc

SEQ ID NO: 158 - DNA, 4204 bp, Artificial Sequence
  Description of Artificial Sequence: Synthetic pDONR202 polynucleotide
  gene (127)..(269): attP1
  gene (486)..(1059): ori
  gene (1228)..(2107): KmR
  gene (2140)..(2381): attP2
  gene (2629)..(3288): CmR
  gene (3408)..(3492): inactivated ccdA
  gene (3630)..(3935): ccdB
cggcattgaggacaatagcgagtaggctggatacgacgattccgtttgagaagaacatttggaaggctgtcggtcgactaagttggcagcatcacccgaagaacatttggaaggctgtcggtcgactacaggtcactaataccatctaagtagttgattcatagtgactggatatgttgtgttttacagtattatgtagtctgttttttatgcaaaatctaatttaatatattgatatttatatcattttacgtttctcgttcagcttttttgtacaaagttggcattataaaaaagcattgctcatcaatttgttgcaacgaacaggtcactatcagtcaaaataaaatcattatttggggcccgagatccatgctagcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagcttgcgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgtttttccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaagcgatagattgtcgcacctgattgcccgacattatcgcgagcccatttatacccatataaatcagcatccatgttggaatttaatcgcggcctcgacgtttcccgttgaatatggctcataacaccccttgtattactgtttatgtaagcagacagttttattgttcatgatgatatatttttatcttgtgcaatgtaacatcagagattttgagacacgggccagagctgcagctggatggcaaataatgattttattttgactgatagtgacctgttcgttgcaacaaattgataagcaatgctttcttataatgccaactttgtacaagaaagctgaacgagaaacgtaaaatgatataaatatcaatatattaaattagattttgcataaaaaacagactacataatactgtaaaacacaacatatccagtcactatgaatcaactacttagatggtattagtgacctgtagtcgactaagttggcagcatcacccgacgcactttgcgccgaataaatacctgtgacggaagatcacttcgcagaataaataaatcctggtgtccctgttgataccgggaagccctgggccaacttttggcgaaaatgagacgttgatcggcacgtaagaggttccaactttcaccataatgaaataagatcactaccgggcgtattttttgagttatcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtctgtgatggcttccatgtcggcagaatgcttaatgaattacaacagtactgcgatgagtggcagggcggggcgtaatcgcgtggatccggcttactaaaagccagataacagtatgcgtatttgcgcgctgatttttgcggtataagaatatatactgatatgtatacccgaagtatgtcaaaaagaggtgtgctatgaagcagcgtattacagtgacagttgacagcgacagctatcagttgctcaaggcatatatgatgtcaatatctccggtctggtaagcacaaccatgcagaatgaagcccgtcgtctgcgtgccgaacgctggaaagcggaaaatcaggaagggatggctgaggtcgcccggtttattgaaatgaacggctcttttgctgacgagaacagggactggtgaaatgcagtttaaggtttacacctataaaagagagagccgttatcgtctgtttgtggatgtacagagtgatattattgacacgcccgggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatataaatgtcaggctcccttatacacagccagtctgcaggtcgatacagtagaaattacagaaactttatcacgtttagtaagtatagaggctgaaaatccagatgaagccgaacgacttgtaagagaaaagtataagagttgtgaaattgttcttgatgcagatgattttcaggactatgacactagcgtatatgaataggtagatgtttttattttgtcacacaaaaaagaggctcgcacctctttttcttatttctttttatgatttaata

SEQ ID NO: 159 - DNA, 4208 bp, Artificial Sequence
  Description of Artificial Sequence: Synthetic pDONR203 polynucleotide
  gene (47)..(131): inactivated ccdA
  gene (251)..(910): CmR
  gene (1158)..(1398): attP2
  gene (1509)..(2082): ori
  gene (2251)..(3130): KmR
  gene (3174)..(3464): attP1
  gene (3812)..(4117): ccdB
gcgttcggcacgcagacgacgggcttcattctgcatggttgtgcttaccagaccggagatattgacatcatatatgccttgagcaactgatagctgtcgctgtcaactgtcactgtaatacgctgcttcatagcacacctctttttgacatacttcgggtatacatatcagtatatattcttataccgcaaaaatcagcgcgcaaatacgcatactgttatctggcttttagtaagccggatccacgcgtttacgccccgccctgccactcatcgcagtactgttgtaattcattaagcattctgccgacatggaagccatcacagacggcatgatgaacctgaatcgccagcggcatcagcaccttgtcgccttgcgtataatatttgcccatggtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaattccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccgatcaacgtctcattttcgccaaaagttggcccagggcttcccggtatcaacagggacaccaggatttatttattctgcgaagtgatcttccgtcacaggtatttattcggcgcaaagtgcgtcgggtgatgctgccaacttagtcgactacaggtcactaataccatctaagtagttgattcatagtgactggatatgttgtgttttacagtattatgtagtctgttttttatgcaaaatctaatttaatatattgatatttatatcattttacgtttctcgttcagctttcttgtacaaagttggcattataagaaagcattgcttatcaatttgttgcaacgaacaggtcactatcagtcaaaataaaatcattatttgccatccagctagcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagcttgcgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgtttttccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaagcgatagattgtcgcacctgattgcccgacattatcgcgagcccatttatacccatataaatcagcatccatgttggaatttaatcgcggcctcgacgtttcccgttgaatatggctcataacaccccttgtattactgtttatgtaagcagacagttttattgttcatgatgatatatttttatcttgtgcaatgtaacatcagagattttgagacacgggccagagctgcagctagcatggatctcgggccccaaataatgattttattttgactgatagtgacctgttcgttgcaacaaattgatgagcaatgcttttttataatgccaactttgtacaaaaaagctgaacgagaaacgtaaaatgatataaatatcaatatattaaattagattttgcataaaaaacagactacataatactgtaaaacacaacatatccagtcactatgaatcaactacttagatggtattagtgacctgtagtcgaccgacagccttccaaatgttcttcgggtgatgctgccaacttagtcgaccgacagccttccaaatgttcttctcaaacggaatcgtcgtatccagcctactcgctattgtcctcaatgccgtattaaatcataaaaagaaataagaaaaagaggtgcgagcctcttttttgtgtgacaaaataaaaacatctacctattcatatacgctagtgtcatagtcctgaaaatcatctgcatcaagaacaatttcacaactcttatacttttctcttacaagtcgttcggcttcatctggattttcagcctctatacttactaaacgtgataaagtttctgtaatttctactgtatcgacctgcagactggctgtgtataagggagcctgacatttatattccccagaacatcaggttaatggcgtttttgatgtcattttcgcggtggctgagatcagccacttcttccccgataacggagaccggcacactggccatatcggtggtcatcatgcgccagctttcatccccgatatgcaccaccgggtaaagttcacgggagactttatctgacagcagacgtgcactggccagggggatcaccatccgtcgcccgggcgtgtcaataatatcactctgtacatccacaaacagacgataacggctctctcttttataggtgtaaaccttaaactgcatttcaccagtccctgttctcgtcagcaaaagagccgttcatttcaataaaccgggcgacctcagccatcccttcctgattttccgctttcca

SEQ ID NO: 160 - DNA, 4165 bp, Artificial Sequence
  Description of Artificial Sequence: Synthetic pDONR204 polynucleotide
  modified_base (1326)..(1326): a, c, t, g, unknown or other
cggcattgaggacaatagcgagtaggctggatacgacgattccgtttgagaagaacatttggaaggctgtcggtcgactacaggtcactaataccatctaagtagttgaatcatagtgactggatatgttgtgttttacagtattatgtagtctgttttttatgcaaaatctaatttaatatattgatatttatatcattttacgtttctcgttcagcttttttgtacaaagttggcattataaaaaagcattgcttatcaatttgttgcaacgaacaggtcactatcagtcaaaataaaatcattatttggggcccgagatccatgctagctgcagtgcgcagggcccgtgtctcaaaatctctgatgttacattgcacaagataaaaatatatcatcatgaacaataaaactgtctgcttacataaacagtaatacaaggggtgttatgagccatattcaacgggaaacgtcttgctggaggccgcgattaaattccaacatggatgctgatttatatgggtataaatgggctcgcgataatgtcgggcaatcaggtgcgacaatctttcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccgcgggaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcatacgcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacactggcagagcattacgctgacttgacgggacggcgncatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgctagctggatcggcaaataatgattttattttgactgatagtgacctgttcgttgcaacaaattgataagcaatgcttttttataatgccaactttgtacaagaaagctgaacgagaaacgtaaaatgatataaatatcaatatattaaattagattttgcataaaaaacagactacataatactgtaaaacacaacatatccagtcactatgattcaactacttagatggtattagtgacctgtagtcgactaagttggcagcatcacccgacgcactttgcgccgaataaatacctgtgacggaagatcacttcgcagaataaataaatcctggtgtccctgttgataccgggaagccctgggccaacttttggcgaaaatgagacgttgatcggcacatttcacaactcttatacttttctcttacaagtcgttcggcttcatctggattttcagcctctatacttactaaacgtgataaagtttctgtaatttctactgtatcgacctgcagactggctgtgtataacggagcctgacatttatattccccagaacatcaggttaatggcgtttttgatgtcattttcgcggtggctgagatcagccacttcttccccgataacggagaccggcacactggccatatcggtggtcatcatgcgccagctttcatccccgatatgcaccaccgggtaaagttcacgggagactttatctgacagcagacgtgcactggccagggggatcaccatccgtcgcccgggcgtgtcaataatatcactctgtacatccacaaacagacgataacggctctctcttttataggtgtaaaccttaaactgcatttcaccagtccctgttctcgtcagcaaaagagccgttcatttcaataaaccgggcgacctcagccatcccttcctgattttccgctttccagcgttcggcacgcagacgacgggcttcattctgcatggttgtgcttaccagaccggagatattgacatcatatatgccttgagcaactgatagctgtcgctgtcaactgtcactgtaatacgctgcttcatagcacacctctttttgacatacttcgggtatacatatcagtatatattcttataccgcaaaaatcagcgcgcaaatacgcatactgttatctggcttttagtaagccggatccacgcgtttacgccccgccctgccactcatcgcagtactgttgtaattcattaagcattctgccgacatggaagccatcacagacggcatgatgaacctgaatcgccagcggcatcagcaccttgtcgccttgcgtataatatttgcccatggtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaattccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttactgttcttgatgcagatgattttcaggactatgacactagcatatatgaataggtagatgtttttattttgtcacacaaaaaagaggctcgcacctctttttcttatttctttttatgatttaata

SEQ ID NO: 161 - DNA, 4939 bp, Artificial Sequence
  Description of Artificial Sequence: Synthetic pDONR205 polynucleotide
ggcatcagcaccttgtcgccttgcgtataatatttgcccatggtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaattccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccgatcaacgtctcattttcgccaaaagttggcccagggcttcccggtatcaacagggacaccaggatttatttattctgcgaagtgatcttccgtcacaggtatttattcggcgcaaagtgcgtcgggtgatgctgccaacttagtcgactacaggtcactaataccatctaagtagttgattcatagtgactggatatgttgtgttttacagtattatgtagtctgttttttatgcaaaatctaatttaatatattgatatttatatcattttacgtttctcgttcagctttcttgtacaaagttggcattataagaaagcattgcttatcaatttgttgcaacgaacaggtcactatcagtcaaaataaaatcattatttgccatccagctgcagctctggcccgtgtctcaaaatctctgatgttacattgcacaagataaaaatatatcatcatgaattctcatgtttgacagcttatcatcgataagctttaatgcggtagtttatcacagttaaattgctaacgcagtcaggcaccgtgtatgaaatctaacaatgcgctcatcgtcatcctcggcaccgtcaccctggatgctgtaggcataggcttggttatgccggtactgccgggcctcttgcgggatatcgtccattccgacagcatcgccagtcactatggcgtgctgctagcgctatatgcgttgatgcaatttctatgcgcacccgttctcggagcactgtccgaccgctttggccgccgcccagtcctgctcgcttcgctacttggagccactatcgactacgcgatcatggcgaccacacccgtcctgtggatcctctacgccggacgcatcgtggccggcatcaccggcgccacaggtgcggttgctggcgcctatatcgccgacatcaccgatggggaagatcgggctcgccacttcgggctcatgagcgcttgtttcggcgtgggtatggtggcaggccccgtggccgggggactgttgggcgccatctccttgcatgcaccattccttgcggcggcggtgctcaacggcctcaacctactactgggctgcttcctaatgcaggagtcgcataagggagagcgtcgaccgatgcccttgagagccttcaacccagtcagctccttccggtgggcgcggggcatgactatcgtcgccgcacttatgactgtcttctttatcatgcaactcgtaggacaggtgccggcagcgctctgggtcattttcggcgaggaccgctttcgctggagcgcgacgatgatcggcctgtcgcttgcggtattcggaatcttgcacgccctcgctcaagccttcgtcactggtcccgccaccaaacgtttcggcgagaagcaggccattatcgccggcatggcggccgacgcgctgggctacgtcttgctggcgttcgcgacgcgaggctggatggccttccccattatgattcttctcgcttccggcggcatcgggatgcccgcgttgcaggccatgctgtccaggcaggtagatgacgaccatcagggacagcttcaaggatcgctcgcggctcttaccagcctaacttcgatcattggaccgctgatcgtcacggcgatttatgccgcctcggcgagcacatggaacgggttggcatggattgtaggcgccgccctataccttgtctgcctccccgcgttgcgtcgcggtgcatggagccgggccacctcgacctgaatggaagccggcggcacctcgctaacggattcaccactccaagaattggagccaatcaattcttgcggagaactgtgaatgcgcaaaccaacccttggcagaacatatccatcgcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgctagccaggaagagtttgtagaaacgcaaaaaggccatccgtcaggatggccttctgcttagtttgatgcctggcagtttatggcgggcgtcctgcccgccaccctccgggccgttgcttcacaacgttcaaatccgctcccggcggatttgtcctactcaggagagcgttcaccgacaaacaacagataaaacgaaaggcccagtcttccgactgagcctttcgttttatttgatgcctggcagttccctactctcgcgttaacgctagcatggatctcgggccccaaataatgattttattttgactgatagtgacctgttcgttgcaacaaattgatgagcaatgcttttttataatgccaactttgtacaaaaaagctgaacgagaaacgtaaaatgatataaatatcaatatattaaattagattttgcataaaaaacagactacataatactgtaaaacacaacatatccagtcactatgaatcaactacttagatggtattagtgacctgtagtcgaccgacagccttccaaatgttcttcgggtgatgctgccaacttagtcgaccgacagccttccaaatgttcttctcaaacggaatcgtcgtatccagcctactcgctattgtcctcaatgccgtattaaatcataaaaagaaataagaaaaagaggtgcgagcctcttttttgtgtgacaaaataaaaacatctacctattcatatacgctagtgtcatagtcctgaaaatcatctgcatcaagaacaatttcacaactcttatacttttctcttacaagtcgttcggcttcatctggattttcagcctctatacttactaaacgtgataaagtttctgtaatttctactgtatcgacctgcagactggctgtgtataagggagcctgacatttatattccccagaacatcaggttaatggcgtttttgatgtcattttcgcggtggctgagatcagccacttcttccccgataacggagaccggcacactggccatatcggtggtcatcatgcgccagctttcatccccgatatgcaccaccgggtaaagttcacgggagactttatctgacagcagacgtgcactggccagggggatcaccatccgtcgcccgggcgtgtcaataatatcactctgtacatccacaaacagacgataacggctctctcttttataggtgtaaaccttaaactgcatttcaccagtccctgttctcgtcagcaaaagagccgttcatttcaataaaccgggcgacctcagccatcccttcctgattttccgctttccagcgttcggcacgcagacgacgggcttcattctgcatggttgtgcttaccagaccggagatattgacatcatatatgccttgagcaactgatagctgtcgctgtcaactgtcactgtaatacgctgcttcatagcacacctctttttgacatacttcgggtatacatatcagtatatattcttataccgcaaaaatcagcgcgcaaatacgcatactgttatctggcttttagtaagccggatccacgcgattacgccccgccctgccactcatcgcagtactgttgtaattcattaagcattctgccgacatggaagccatcacagacggcatgatgaacctgaatcgccagc

SEQ ID NO: 162 - DNA, 5156 bp, Artificial Sequence
  Description of Artificial Sequence: Synthetic pDONR206 polynucleotide
  modified_base (1102)..(1102): a, c, t, g, unknown or other
  modified_base (3080)..(3080): a, c, t, g, unknown or other
cggcattgaggacaatagcgagtaggctggatacgacgattccgtttgagaagaacatttggaaggctgtcggtcgactacaggtcactaataccatctaagtagttgaatcatagtgactggatatgttgtgttttacagtattatgtagtctgttttttatgcaaaatctaatttaatatattgatatttatatcattttacgtttctcgttcagcttttttgtacaaagttggcattataaaaaagcattgcttatcaatttgttgcaacgaacaggtcactatcagtcaaaataaaatcattatttggggcccgagatccatgctagcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgncgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattagccgaggtcttccgatctcctgaagccagggcagatccgtgcacagcaccttgccgtagaagaacagcaaggccgccaatgcctgacgatgcgtggagaccgaaaccttgcgctcgttcgccagccaggacagaaatgcctcgacttcgctgctgcccaaggttgccgggtgacgcacaccgtggaaacggatgaaggcacgaacccagttgacataagcctgttcggttcgtaaactgtaatgcaagtagcgtatgcgctcacgcaactggtccagaaccttgaccgaacgcagcggtggtaacggcgcagtggcggttttcatggcttgttatgactgtttttttgtacagtctatgcctcgggcatccaagcagcaagcgcgttacgccgtgggtcgatgtttgatgttatggagcagcaacgatgttacgcagcagcaacgatgttacgcagcagggcagtcgccctaaaacaaagttaggtggctcaagtatgggcatcattcgcacatgtaggctcggccctgaccaagtcaaatccatgcgggctgctcttgatcttttcggtcgtgagttcggagacgtagccacctactcccaacatcagccggactccgattacctcgggaacttgctccgtagtaagacattcatcgcgcttgctgccttcgaccaagaagcggttgttggcgctctcgcggcttacgttctgcccaggtttgagcagccgcgtagtgagatctatatctatgatctcgcagtctccggcgagcaccggaggcagggcattgccaccgcgctcatcaatctcctcaagcatgaggccaacgcgcttggtgcttatgtgatctacgtgcaagcagattacggtgacgatcccgcagtggctctctatacaaagttgggcatacgggaagaagtgatgcactttgatatcgacccaagtaccgccacctaacaattcgttcaagccgagatcggcttcccggcctaatttcccctcgtcaaaaataaggttatcaagtgagaaatcaccatgagtgacgactgaatccggtgagaatggcaaaagcgtatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccgcggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgaaagattgtcgcacctgattgcccgacattatcgcgagcccatttatacccatataaatcagcatccatgttggaatttaatcgcggcctccagcaagacgtttcccgttgaatatggctcataacaccccttgtattactgtttatgtaagcagacagttttattgttcatgatgatatatttttatcttgtgcaatgtaacatcagagattttgagacacgggcccngcgcactgcagctggatcggcaaataatgattttattttgactgatagtgacctgttcgttgcaacaaattgataagcaatgcttttttataatgccaactttgtacaagaaagctgaacgagaaacgtaaaatgatataaatatcaatatattaaattagattttgcataaaaaacagactacataatactgtaaaacacaacatatccagtcactatgattcaactacttagatggtattagtgacctgtagtcgactaagttggcagcatcacccgacgcactttgcgccgaataaatacctgtgacggaagatcacttcgcagaataaataaatcctggtgtccctgttgataccgggaagccctgggccaacttttggcgaaaatgagacgttgatcggcacgtaagaggttccaactttcaccataatgaaataagatcactaccgggcgtattttttgagttatcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtctgtgatggcttccatgtcggcagaatgcttaatgaattacaacagtactgcgatgagtggcagggcggggcgtaaacgcgtggatccggcttactaaaagccagataacagtatgcgtatttgcgcgctgatttttgcggtataagaatatatactgatatgtatacccgaagtatgtcaaaaagaggtgtgctatgaagcagcgtattacagtgacagttgacagcgacagctatcagttgctcaaggcatatatgatgtcaatatctccggtctggtaagcacaaccatgcagaatgaagcccgtcgtctgcgtgccgaacgctggaaagcggaaaatcaggaagggatggctgaggtcgcccggtttattgaaatgaacggctcttttgctgacgagaacagggactggtgaaatgcagtttaaggtttacacctataaaagagagagccgttatcgtctgtttgtggatgtacagagtgatattattgacacgcccgggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatataaatgtcaggctccgttatacacagccagtctgcaggtcgatacagtagaaattacagaaactttatcacgtttagtaagtatagaggctgaaaatccagatgaagccgaacgacttgtaagagaaaagtataagagttgtgaaattgttcttgatgcagatgattttcaggactatgacactagcatatatgaataggtagatgtttttattttgtcacacaaaaaagaggctcgcacctctttttcttatttctttttatgatttaata

SEQ ID NO: 163 - DNA, 21 bp, Artificial Sequence
  Description of Artificial Sequence: Synthetic attR1 Reading Frame A oligonucleotide
atcacaagtttgtacaaaaaa

SEQ ID NO: 164 - DNA, 22 bp, Artificial Sequence
  Description of Artificial Sequence: Synthetic attR1 Reading Frame B oligonucleotide
atcaacaagtttgtacaaaaaa

SEQ ID NO: 165 - DNA, 23 bp, Artificial Sequence
  Description of Artificial Sequence: Synthetic attR1 Reading Frame C oligonucleotide
atcaaacaagtttgtacaaaaaa

SEQ ID NO: 166 - DNA, 21 bp, Artificial Sequence
  Description of Artificial Sequence: Synthetic attR2 Reading Frame A oligonucleotide
tttcttgtacaaagtggtgat

SEQ ID NO: 167 - DNA, 22 bp, Artificial Sequence
  Description of Artificial Sequence: Synthetic attR2 Reading Frame B oligonucleotide
tttcttgtacaaagtggttgat

SEQ ID NO: 168 - DNA, 23 bp, Artificial Sequence
  Description of Artificial Sequence: Synthetic attR2 Reading Frame C oligonucleotide
tttcttgtacaaagtggttcgat

SEQ ID NO: 169 - DNA, 23 bp, Artificial Sequence
  Description of Artificial Sequence: Synthetic attR1 Reading Frame C (Alternative B) oligonucleotide
atcaaacaagtttgtacaaaaaa

SEQ ID NO: 170 - DNA, 23 bp, Artificial Sequence
  Description of Artificial Sequence: Synthetic attR2 Reading Frame C (Alternative B) oligonucleotide
tttcttgtacaaagtggtttgat

SEQ ID NO: 171 - DNA, 30 bp, Artificial Sequence
  Description of Artificial Sequence: Synthetic attR1 Reading Frame A Cassette oligonucleotide
  modified_base (1)..(6): a, c, t, g, unknown or other
nnnnnnatcacaagtttgtacaaaaaagct

SEQ ID NO: 172 - DNA, 33 bp, Artificial Sequence
  Description of Artificial Sequence: Synthetic attR1 Reading Frame B Cassette oligonucleotide
  modified_base (1)..(8): a, c, t, g, unknown or other
nnnnnnnnatcaacaagtttgtacaaaaaagct

SEQ ID NO: 173 - DNA, 33 bp, Artificial Sequence
  Description of Artificial Sequence: Synthetic attR1 Reading Frame C Cassette oligonucleotide
  modified_base (1)..(7): a, c, t, g, unknown or other
nnnnnnnatcaaacaagtttgtacaaaaaagct

SEQ ID NO: 174 - DNA, 4554 bp, Artificial Sequence
  Description of Artificial Sequence: Synthetic prfC Parent III polynucleotide
  gene (286)..(410): attR1
  gene (660)..(1319): CmR
  gene (1439)..(1523): inactivated ccdA
  gene (1661)..(1966): ccdB
  gene (2007)..(2131): attR2
  gene (2753)..(3613): amp
gcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttgcatgcctgcaggtcgactctagaggatccccgggtaccgatatcaaacaagtttgtacaaaaaagctgaacgagaaacgtaaaatgatataaatatcaatatattaaattagattttgcataaaaaacagactacataatactgtaaaacacaacatatccagtcactatggcggccgctaagttggcagcatcacccgacgcactttgcgccgaataaatacctgtgacggaagatcacttcgcagaataaataaatcctggtgtccctgttgataccgggaagccctgggccaacttttggcgaaaatgagacgttgatcggcacgtaagaggttccaactttcaccataatgaaataagatcactaccgggcgtattttttgagttatcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtctgtgatggcttccatgtcggcagaatgcttaatgaattacaacagtactgcgatgagtggcagggcggggcgtaatctagaggatccggcttactaaaagccagataacagtatgcgtatttgcgcgctgatttttgcggtataagaatatatactgatatgtatacccgaagtatgtcaaaaagaggtgtgctatgaagcagcgtattacagtgacagttgacagcgacagctatcagttgctcaaggcatatatgatgtcaatatctccggtctggtaagcacaaccatgcagaatgaagcccgtcgtctgcgtgccgaacgctggaaagcggaaaatcaggaagggatggctgaggtcgcccggtttattgaaatgaacggctcttttgctgacgagaacagggactggtgaaatgcagtttaaggtttacacctataaaagagagagccgttatcgtctgtttgtggatgtacagagtgatattattgacacgcccgggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatataaatgtcaggctccgttatacacagccagtctgcaggtcgaccatagtgactggatatgttgtgttttacagtattatgtagtctgttttttatgcaaaatctaatttaatatattgatatttatatcattttacgtttctcgttcagctttcttgtacaaagtggttcgatatcggtaccgagctcgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaaga

SEQ ID NO: 175 - DNA, 7141 bp, Artificial Sequence
  Description of Artificial Sequence: Synthetic pDEST28 polynucleotide
atgcatgtcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctccctatcagtgatagagatctccctatcagtgatagagatcgtcgacgagctcgtttagtgaaccgtcagatcgcctggagacgccatccacgctgttttgacctccatagaagacaccgggaccgatccagcctccggactctagaggatccctaccggtgatatcctcgagcccatcaacaagtttgtacaaaaaagctgaacgagaaacgtaaaatgatataaatatcaatatattaaattagattttgcataaaaaacagactacataatactgtaaaacacaacatatccagtcactatggcggccgcattaggcaccccaggctttacactttatgcttccggctcgtataatgtgtggattttgagttaggatccggcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtctgtgatggcttccatgtcggcagaatgcttaatgaattacaacagtactgcgatgagtggcagggcggggcgtaaagatctggatccggcttactaaaagccagataacagtatgcgtatttgcgcgctgatttttgcggtataagaatatatactgatatgtatacccgaagtatgtcaaaaagaggtgtgctatgaagcagcgtattacagtgacagttgacagcgacagctatcagttgctcaaggcatatatgatgtcaatatctccggtctggtaagcacaaccatgcagaatgaagcccgtcgtctgcgtgccgaacgctggaaagcggaaaatcaggaagggatggctgaggtcgcccggtttattgaaatgaacggctcttttgctgacgagaacagggactggtgaaatgcagtttaaggtttacacctataaaagagagagccgttatcgtctgtttgtggatgtacagagtgatattattgacacgcccgggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatataaatgtcaggctcccttatacacagccagtctgcaggtcgaccatagtgactggatatgttgtgttttacagtattatgtagtctgttttttatgcaaaatctaatttaatatattgatatttatatcattttacgtttctcgttcagctttcttgtacaaagtggttgatgggcggccgctctagagggcccaagcttacgcgtgcatgcgacgtcatagctctctccctatagtgagtcgtattataagctaggcactggccgtcgttttacaacgtcgtgactgggaaaactgctagcttgggatctttgtgaaggaaccttacttctgtggtgtgacataattggacaaactacctacagagatttaaagctctaaggtaaatataaaatttttaagtgtataatgtgttaaactagctgcatatgcttgctgcttgagagttttgcttactgagtatgatttatgaaaatattatacacaggagctagtgattctaattgtttgtgtattttagattcacagtcccaaggctcatttcaggcccctcagtcctcacagtctgttcatgatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggatcgatcctgcattaatgaatcggccaacgcgcggggagaggcggtttgcgtattggctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaatatttaacgcgaattttaacaaaatattaacgtttacaatttcgcctgatgcggtattttctccttacgcatctgtgcggtatttcacaccgcatacgcggatctgcgcagcaccatggcctgaaataacctctgaaagaggaacttggttaggtaccttctgaggcggaaagaaccagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagcttgattcttctgacacaacagtctcgaacttaagaccatggccaagcctttgtctcaagaagaatccaccctcattgaaagagcaacggctacaatcaacagcatccccatctctgaagactacagcgtcgccagcgcagctctctctagcgacggccgcatcttcactggtgtcaatgtatatcattttactgggggaccttgtgcagaactcgtggtgctgggcactgctgctgctgcggcagctggcaacctgacttgtatcgtcgcgatcggaaatgagaacaggggcatcttgagcccctgcggacggtgccgacaggtgcttctcgatctgcatcctgggatcaaagccatagtgaaggacagtgatggacagccgacggcagttgggattcgtgaattgctgccctctggttatgtgtgggagggctaagcacttcgtggccgagttcgaaatgaccgaccaagcgacgcccaacctgccatcacgatggccgcaataaaatatctttattttcattacatctgtgtgttggttttttgtgtgaatcgatagcgataaggatccgcgtatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagagcttgcaattcgcgcgtttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtagtacgaggccctttcactcattag

SEQ ID NO: 176 - DNA, 7156 bp, Artificial Sequence
  Description of Artificial Sequence: Synthetic pDEST29 polynucleotide
atgcatgtcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctccctatcagtgatagagatctccctatcagtgatagagatcgtcgacgagctcgtttagtgaaccgtcagatcgcctggagacgccatccacgctgttttgacctccatagaagacaccgggaccgatccagcctccggaccatggcgtactaccatcaccatcaccatcacaccggtgatatcctcgagcccatcacaagtttgtacaaaaaagctgaacgagaaacgtaaaatgatataaatatcaatatattaaattagattttgcataaaaaacagactacataatactgtaaaacacaacatatccagtcactatggcggccgcattaggcaccccaggctttacactttatgcttccggctcgtataatgtgtggattttgagttaggatccggcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtctgtgatggcttccatgtcggcagaatgcttaatgaattacaacagtactgcgatgagtggcagggcggggcgtaaacgcgtggatccggcttactaaaagccagataacagtatgcgtatttgcgcgctgatttttgcggtataagaatatatactgatatgtatacccgaagtatgtcaaaaagaggtgtgctatgaagcagcgtattacagtgacagttgacagcgacagctatcagttgctcaaggcatatatgatgtcaatatctccggtctggtaagcacaaccatgcagaatgaagcccgtcgtctgcgtgccgaacgctggaaagcggaaaatcaggaagggatggctgaggtcgcccggtttattgaaatgaacggctcttttgctgacgagaacagggactggtgaaatgcagtttaaggtttacacctataaaagagagagccgttatcgtctgtttgtggatgtacagagtgatattattgacacgcccgggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatataaatgtcaggctccgttatacacagccagtctgcaggtcgaccatagtgactggatatgttgtgttttacagtattatgtagtctgttttttatgcaaaatctaatttaatatattgatatttatatcattttacgtttctcgttcagctttcttgtacaaagtggtgatgggcggccgctctagagggcccaagcttacgcgtgcatgcgacgtcatagctctctccctatagtgagtcgtattataagctaggcactggccgtcgttttacaacgtcgtgactgggaaaactgctagcttgggatctttgtgaaggaaccttacttctgtggtgtgacataattggacaaactacctacagagatttaaagctctaaggtaaatataaaatttttaagtgtataatgtgttaaactagctgcatatgcttgctgcttgagagttttgcttactgagtatgatttatgaaaatattatacacaggagctagtgattctaattgtttgtgtattttagattcacagtcccaaggctcatttcaggcccctcagtcctcacagtctgttcatgatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggatcgatcctgcattaatgaatcggccaacgcgcggggagaggcggtttgcgtattggctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaatatttaacgcgaattttaacaaaatattaacgtttacaatttcgcctgatgcggtattttctccttacgcatctgtgcggtatttcacaccgcatacgcggatctgcgcagcaccatggcctgaaataacctctgaaagaggaacttggttaggtaccttctgaggcggaaagaaccagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagcttgattcttctgacacaacagtctcgaacttaagaccatggccaagcctttgtctcaagaagaatccaccctcattgaaagagcaacggctacaatcaacagcatccccatctctgaagactacagcgtcgccagcgcagctctctctagcgacggccgcatcttcactggtgtcaatgtatatcattttactgggggaccttgtgcagaactcgtggtgctgggcactgctgctgctgcggcagctggcaacctgacttgtatcgtcgcgatcggaaatgagaacaggggcatcttgagcccctgcggacggtgccgacaggtgcttctcgatctgcatcctgggatcaaagccatagtgaaggacagtgatggacagccgacggcagttgggattcgtgaattgctgccctctggttatgtgtgggagggctaagcacttcgtggccgagttcgaaatgaccgaccaagcgacgcccaacctgccatcacgatggccgcaataaaatatctttattttcattacatctgtgtgttggttttttgtgtgaatcgatagcgataaggatccgcgtatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagagcttgcaattcgcgcgtttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtagtacgaggccctttcactcattag

SEQ ID NO: 177 - DNA, 7544 bp, Artificial Sequence
  Description of Artificial Sequence: Synthetic pDEST30 polynucleotide
atgcatgtcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctccctatcagtgatagagatctccctatcagtgatagagatcgtcgacgagctcgtttagtgaaccgtcagatcgcctggagacgccatccacgctgttttgacctccatagaagacaccgggaccgatccagcctccggactctagaggatccctaccggtgatatcctcgagcccatcaacaagtttgtacaaaaaagctgaacgagaaacgtaaaatgatataaatatcaatatattaaattagattttgcataaaaaacagactacataatactgtaaaacacaacatatccagtcactatggcggccgcattaggcaccccaggctttacactttatgcttccggctcgtataatgtgtggattttgagttaggatccggcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtctgtgatggcttccatgtcggcagaatgcttaatgaattacaacagtactgcgatgagtggcagggcggggcgtaaagatctggatccggcttactaaaagccagataacagtatgcgtatttgcgcgctgatttttgcggtataagaatatatactgatatgtatacccgaagtatgtcaaaaagaggtgtgctatgaagcagcgtattacagtgacagttgacagcgacagctatcagttgctcaaggcatatatgatgtcaatatctccggtctggtaagcacaaccatgcagaatgaagcccgtcgtctgcgtgccgaacgctggaaagcggaaaatcaggaagggatggctgaggtcgcccggtttattgaaatgaacggctcttttgctgacgagaacagggactggtgaaatgcagtttaaggtttacacctataaaagagagagccgttatcgtctgtttgtggatgtacagagtgatattattgacacgcccgggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatataaatgtcaggctcccttatacacagccagtctgcaggtcgaccatagtgactggatatgttgtgttttacagtattatgtagtctgttttttatgcaaaatctaatttaatatattgatatttatatcattttacgtttctcgttcagctttcttgtacaaagtggttgatgggcggccgctctagagggcccaagcttacgcgtgcatgcgacgtcatagctctctccctatagtgagtcgtattataagctaggcactggccgtcgttttacaacgtcgtgactgggaaaactgctagcttgggatctttgtgaaggaaccttacttctgtggtgtgacataattggacaaactacctacagagatttaaagctctaaggtaaatataaaatttttaagtgtataatgtgttaaactagctgcatatgcttgctgcttgagagttttgcttactgagtatgatttatgaaaatattatacacaggagctagtgattctaattgtttgtgtattttagattcacagtcccaaggctcatttcaggcccctcagtcctcacagtctgttcatgatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggatcgatcctgcattaatgaatcggccaacgcgcggggagaggcggtttgcgtattggctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaatatttaacgcgaattttaacaaaatattaacgtttacaatttcgcctgatgcggtattttctccttacgcatctgtgcggtatttcacaccgcatacgcggatctgcgcagcaccatggcctgaaataacctctgaaagaggaacttggttaggtaccttctgaggcggaaagaaccagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagcttgattcttctgacacaacagtctcgaacttaaggctagagccaccatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgatggccgcaataaaatatctttattttcattacatctgtgtgttggttttttgtgtgaatcgatagcgataaggatccgcgtatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagagcttgcaattcgcgcgtttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtagtacgaggccctttcactcattag

SEQ ID NO: 178 - DNA, 7559 bp, Artificial Sequence
  Description of Artificial Sequence: Synthetic pDEST31 polynucleotide
atgcatgtcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctccctatcagtgatagagatctccctatcagtgatagagatcgtcgacgagctcgtttagtgaaccgtcagatcgcctggagacgccatccacgctgttttgacctccatagaagacaccgggaccgatccagcctccggaccatggcgtactaccatcaccatcaccatcacaccggtgatatcctcgagcccatcacaagtttgtacaaaaaagctgaacgagaaacgtaaaatgatataaatatcaatatattaaattagattttgcataaaaaacagactacataatactgtaaaacacaacatatccagtcactatggcggccgcattaggcaccccaggctttacactttatgcttccggctcgtataatgtgtggattttgagttaggatccggcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtctgtgatggcttccatgtcggcagaatgcttaatgaattacaacagtactgcgatgagtggcagggcggggcgtaaacgcgtggatccggcttactaaaagccagataacagtatgcgtatttgcgcgctgatttttgcggtataagaatatatactgatatgtatacccgaagtatgtcaaaaagaggtgtgctatgaagcagcgtattacagtgacagttgacagcgacagctatcagttgctcaaggcatatatgatgtcaatatctccggtctggtaagcacaaccatgcagaatgaagcccgtcgtctgcgtgccgaacgctggaaagcggaaaatcaggaagggatggctgaggtcgcccggtttattgaaatgaacggctcttttgctgacgagaacagggactggtgaaatgcagtttaaggtttacacctataaaagagagagccgttatcgtctgtttgtggatgtacagagtgatattattgacacgcccgggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatataaatgtcaggctccgttatacacagccagtctgcaggtcgaccatagtgactggatatgttgtgttttacagtattatgtagtctgttttttatgcaaaatctaatttaatatattgatatttatatcattttacgtttctcgttcagctttcttgtacaaagtggtgatgggcggccgctctagagggcccaagcttacgcgtgcatgcgacgtcatagctctctccctatagtgagtcgtattataagctaggcactggccgtcgttttacaacgtcgtgactgggaaaactgctagcttgggatctttgtgaaggaaccttacttctgtggtgtgacataattggacaaactacctacagagatttaaagctctaaggtaaatataaaatttttaagtgtataatgtgttaaactagctgcatatgcttgctgcttgagagttttgcttactgagtatgatttatgaaaatattatacacaggagctagtgattctaattgtttgtgtattttagattcacagtcccaaggctcatttcaggcccctcagtcctcacagtctgttcatgatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggatcgatcctgcattaatgaatcggccaacgcgcggggagaggcggtttgcgtattggctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaatatttaacgcgaattttaacaaaatattaacgtttacaatttcgcctgatgcggtattttctccttacgcatctgtgcggtatttcacaccgcatacgcggatctgcgcagcaccatggcctgaaataacctctgaaagaggaacttggttaggtaccttctgaggcggaaagaaccagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagcttgattcttctgacacaacagtctcgaacttaaggctagagccaccatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgatggccgcaataaaatatctttattttcattacatctgtgtgttggttttttgtgtgaatcgatagcgataaggatccgcgtatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagagcttgcaattcgcgcgtttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtagtacgaggccctttcactcattag

SEQ ID NO: 179 - DNA, 12288 bp, Artificial Sequence
  Description of Artificial Sequence: Synthetic pDEST32 polynucleotide
  modified_base (2263)..(2263): a, c, t, g, unknown or other
gacgaaagggcctcgtgatacgcctatttttataggttaatgtcatgataataatggtttcttaggacggatcgcttgcctgtaacttacacgcgcctcgtatcttttaatgatggaataatttgggaatttactctgtgtttatttatttttatgttttgtatttggattttagaaagtaaataaagaaggtagaagagttacggaatgaagaaaaaaaaataaacaaaggtttaaaaaatttcaacaaaaagcgtactttacatatatatttattagacaagaaaagcagattaaatagatatacattcgattaacgataagtaaaatgtaaaatcacaggattttcgtgtgtggtcttctacacagacaagatgaaacaattcggcattaatacctgagagcaggaagagcaagataaaaggtagtatttgttggcgatccccctagagtcttttacatcttcggaaaacaaaaactattttttctttaatttctttttttactttctatttttaatttatatatttatattaaaaaatttaaattataattatttttatagcacgtgatgaaaaggacccaggtggcacttttcggggaaatgtgcgcggaacccctatttgtttatttttctaaatacattcaaatatgtatccgctcatgagacaataaccctgataaatgcttcaataatctgcagtgcgcagggcccgtgtctcaaaatctctgatgttacattgcacaagataaaaatatatcatcatgaacaataaaactgtctgcttacataaacagtaatacaaggggtgttatgagccatattcaacgggaaacgtcttgctggaggccgcgattaaattccaacatggatgctgatttatatgggtataaatgggctcggtagccaaccactagaactatagctagagtcctgggcgaacaaacgatgctcgccttccagaaaaccgaggatgcgaaccacttcatccggggtcagcaccaccggcaagcgccgcgacggccgaggtcttccgatctcctgaagccagggcagatccgtgcacagcaccttgccgtagaagaacagcaaggccgccaatgcctgacgatgcgtggagaccgaaaccttgcgctcgttcgccagccaggacagaaatgcctcgacttcgctgctgcccaaggttgccgggtgacgcacaccgtggaaacggatgaaggcacgaacccagttgacataagcctgttcggttcgtaaactgtaatgcaagtagcgtatgcgctcacgcaactggtccagaaccttgaccgaacgcagcggtggtaacggcgcagtggcggttttcatggcttgttatgactgtttttttgtacagtctatgcctcgggcatccaagcagcaagcgcgttacgccgtgggtcgatgtttgatgttatggagcagcaacgatgttacgcagcagcaacgatgttacgcagcagggcagtcgccctaaaacaaagttaggtggctcaagtatgggcatcattcgcacatgtaggctcggccctgaccaagtcaaatccatgcgggctgctcttgatcttttcggtcgtgagttcggagacgtagccacctactcccaacatcagccggactccgattacctcgggaacttgctccgtagtaagacattcatcgcgcttgctgccttcgaccaagaagcggttgttggcgctctcgcggcttacgttctgcccaggtttgagcagccgcgtagtgagatctatatctatgatctcgcagtctccggcgagcaccggaggcagggcattgccaccgcgctcatcaatctcctcaagcatgaggccaacgcgcttggtgcttatgtgatctacgtgcaagcagattacggtgacgatcccgcagtggctctctatacaaagttgggcatacgggaagaagtgatgcactttgatatcgacccaagtaccgccacctaacaattcgttcaagccgagatcggcttcccggcctaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacactggcagagcattacgctgacttgacgggacggcgncatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccaggggggaacgcctggtatctttatagtcctgtcgggtttcgccacctctgacttgagcgtcgatttttgtgatgctcgtcaggggggccgagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttacctcactcattaggcaccccaggctttacactttatgcttccggctcctatgttgtgtggaattgtgagcggataacaatttcacacaggaaacagctatgaccatgattacgccaagctcggaattaaccctcactaaagggaacaaaagctggtaccgatcccgagctttgcaaattaaagccttcgagcgtcccaaaaccttctcaagcaaggttttcagtataatgttacatgcgtacacgcgtctgtacagaaaaaaaagaaaaatttgaaatataaataacgttcttaatactaacataactataaaaaaataaatagggacctagacttcaggttgtctaactccttccttttcggttagagcggatgtggggggagggcgtgaatgtaagcgtgacataactaattacatgatatcgacaaaggaaaaggggcctgtttactcacaggcttttttcaagtaggtaattaagtcgtttctgtctttttccttcttcaacccaccaaaggccatcttggtacttttttttttttttttttttttttttttttttttttttttttttttttttttttttttttttttttttttttttttttttttttttttttttttcatagaaataatacagaagtagatgttgaattagattaaactgaagatatataatttattggaaaatacatagagctttttgttgatgcgcttaagcgatcaattcaacaacaccaccagcagctctgattttttcttcagccaacttggagacgaatctagctttgacgataactggaacatttggaattctacccttacccaagatcttaccgtaaccggctgccaaagtgtcaataactggagcagtttccttagaagcagatttcaagtattggtctctcttgtcttctgggatcaatgtccacaatttgtccaagttcaagactggcttccagaaatgagcttgttgcttgtggaagtatctcataccaaccttaccgaaataacctggatggtatttatccatgttaattctgtggtgatgttgaccaccggccatacctctaccaccggggtgctttctgtgcttaccgatacgacctttaccggctgagacgtgacctctgtgctttctagtcttagtgaatctggaaggcattcttgattagttggatgattgttctgggatttaatgcaaaaatcacttaagaaggaaaatcaacggagaaagcaaacgccatcttaaatatacgggatacagatgaaagggtttgaacctatctggaaaatagcattaaacaagcgaaaaactgcgaggaaaattgtttgcgtctctgcgggctattcacgcgccagaggaaaataggaaaaataacagggcattagaaaaataattttgattttggtaatgtgtgggtcctggtgtacagatgttacattggttacagtactcttgtttttgctgtgtttttcgatgaatctccaaaatggttgttagcacatggaagagtcaccgatgctaagttatctctatgtaagctacgtggcgtgacttttgatgaagccgcacaagagatacaggattggcaactgcaaatagaatctggggatcccccctcgagatccgggatcgaagaaatgatggtaaatgaaataggaaatcaaggagcatgaaggcaaaagacaaatataagggtcgaacgaaaaataaagtgaaaagtgttgatatgatgtatttggctttgcggcgccgaaaaaacgagtttacgcaattgcacaatcatgctgactctgtggcggacccgcgctcttgccggcccggcgataacgctgggcgtgaggctgtgcccggcggagttttttgcgcctgcattttccaaggtttaccctgcgctaaggggcgagattggagaagcaataagaatgccggttggggttgcgatgatgacgaccacgacaactggtgtcattatttaagttgccgaaagaacctgagtgcatttgcaacatgagtatactagaagaatgagccaagacttgcgagacgcgagtttgccggtggtgcgaacaatagagcgaccatgaccttgaaggtgagacgcgcataaccgctagagtactttgaagaggaaacagcaatagggttgctaccagtataaatagacaggtacatacaacactggaaatggttgtctgtttgagtacgctttcaattcatttgggtgtgcactttattatgttacaatatggaagggaactttacacttctcctatgcacatatattaattaaagtccaatgctagtagagaaggggggtaacacccctccgcgctcttttccgatttttttctaaaccgtggaatatttcggatatccttttgttgtttccgggtgtacaatatggacttcctcttttctggcaaccaaacccatacatcgggattcctataataccttcgttggtctccctaacatgtaggtggcggaggggagatatacaatagaacagataccagacaagacataatgggctaaacaagactacaccaattacactgcctcattgatggtggtacataacgaactaatactgtagccctagacttgatagccatcatcatatcgaagtttcactaccctttttccatttgccatctattgaagtaataataggcgcatgcaacttcttttctttttttttcttttctctctcccccgttgttgtctcaccatatccgcaatgacaaaaaaaatgatggaagacactaaaggaaaaaattaacgacaaagacagcaccaacagatgtcgttgttccagagctgatgaggggtatcttcgaacacacgaaactttttccttccttcattcacgcacactactctctaatgagcaacggtatacggccttccttccagttacttgaatttgaaataaaaaaagtttgccgctttgctatcaagtataaatagacctgcaattattaatcttttgtttcctcgtcattgttctcgttccctttcttccttgtttctttttctgcacaatatttcaagctataccaagcatacaatcaactccaagcttgaagcaagcctcctgaaagatgaagctactgtcttctatcgaacaagcatgcgatatttgccgacttaaaaagctcaagtgctccaaagaaaaaccgaagtgcgccaagtgtctgaagaacaactgggagtgtcgctactctcccaaaaccaaaaggtctccgctgactagggcacatctgacagaagtggaatcaaggctagaaagactggaacagctatttctactgatttttcctcgagaagaccttgacatgattttgaaaatggattctttacaggatataaaagcattgttaacaggattatttgtacaagataatgtgaataaagatgccgtcacagatagattggcttcagtggagactgatatgcctctaacattgagacagcatagaataagtgcgacatcatcatcggaagagagtagtaacaaaggtcaaagacagttgactgtatcgtcgaggtcgaatcaaacaagtttgtacaaaaaagctgaacgagaaacgtaaaatgatataaatatcaatatattaaattagattttgcataaaaaacagactacataatactgtaaaacacaacatatccagtcactatggcggccgctaagttggcagcatcacccgacgcactttgcgccgaataaatacctgtgacggaagatcacttcgcagaataaataaatcctggtgtccctgttgataccgggaagccctgggccaacttttggcgaaaatgagacgttgatcggcacgtaagaggttccaactttcaccataatgaaataagatcactaccgggcgtattttttgagttatcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtctgtgatggcttccatgtcggcagaatgcttaatgaattacaacagtactgcgatgagtggcagggcggggcgtaatctagaggatccggcttactaaaagccagataacagtatgcgtatttgcgcgctgatttttgcggtataagaatatatactgatatgtatacccgaagtatgtcaaaaagaggtgtgctatgaagcagcgtattacagtgacagttgacagcgacagctatcagttgctcaaggcatatatgatgtcaatatctccggtctggtaagcacaaccatgcagaatgaagcccgtcgtctgcgtgccgaacgctggaaagcggaaaatcaggaagggatggctgaggtcgcccggtttattgaaatgaacggctcttttgctgacgagaacagggactggtgaaatgcagtttaaggtttacacctataaaagagagagccgttatcgtctgtttgtggatgtacagagtgatattattgacacgcccgggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatataaatgtcaggctcccttatacacagccagtctgcaggtcgaccatagtgactggatatgttgtgttttacagtattatgtagtctgttttttatgcaaaatctaatttaatatattgatatttatatcattttacgtttctcgttcagctttcttgtacaaagtggtttgatggccgctaagtaagtaagacgtcgagctctaagtaagtaacggccgccaccgcggtggagctttggacttcttcgccagaggtttggtcaagtctccaatcaaggttgtcggcttgtctaccttgccagaaatttacgaaaagatggaaaagggtcaaatcgttggtagatacgttgttgacacttctaaataagcgaatttcttatgatttatgatttttattattaaataagttataaaaaaaataagtgtatacaaattttaaagtgactcttaggttttaaaacgaaaattcttgttcttgagtaactctttcctgtaggtcaggttgctttctcaggtatagcatgaggtcgctcttattgaccacacctctaccggcatgccgagcaaatgcctgcaaatcgctccccatttcacccaattgtagatatgctaactccagcaatgagttgatgaatctcggtgtgtattttatgtcctcagaggacaatacctgttgtaatcgttcttccacacggatcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcctgatgcggtattttctccttacgcatctgtgcggtatttcacaccgcatatcgaccggtcgaggagaacttctagtatatccacatacctaatattattgccttattaaaaatggaatcggaacaattacatcaaaatccacattctcttcaaaatcaattgtcctgtacttccttgttcatgtgtgttcaaaaacgttatatttataggataattatactctatttctcaacaagtaattggttgtttggccgagcggtctaaggcgcctgattcaagaaatatcttgaccgcagttaactgtgggaatactcaggtatcgtaagatgcaagagttcgaatctcttagcaaccattatttttttcctcaacataacgagaacacacaggggcgctatcgcacagaatcaaattcgatgactggaaattttttgttaatttcagaggtcgcctgacgcatatacctttttcaactgaaaaattgggagaaaaaggaaaggtgagaggccggaaccggcttttcatatagaatagagaagcgttcatgactaaatgcttgcatcacaatacttgaagttgacaatattatttaaggacctattgttttttccaataggtggttagcaatcgtcttactttctaacttttcttaccttttacatttcagcaatatatatatatatttcaaggatataccattctaatgtctgcccctatgtctgcccctaagaagatcgtcgttttgccaggtgaccacgttggtcaagaaatcacagccgaagccattaaggttcttaaagctatttctgatgttcgttccaatgtcaagttcgatttcgaaaatcatttaattggtggtgctgctatcgatgctacaggtgtcccacttccagatgaggcgctggaagcctccaagaaggttgatgccgttttgttaggtgctgtgggtggtcctaaatggggtaccggtagtgttagacctgaacaaggtttactaaaaatccgtaaagaacttcaattgtacgccaacttaagaccatgtaactttgcatccgactctcttttagacttatctccaatcaagccacaatttgctaaaggtactgacttcgttgttgtcagagaattagtgggaggtatttactttggtaagagaaaggaagacgatggtgatggtgtcgcttgggatagtgaacaatacaccgttccagaagtgcaaagaatcacaagaatggccgctttcatggccctacaacatgagccaccattgcctatttggtccttggataaagctaatgttttggcctcttcaagattatggagaaaaactgtggaggaaaccatcaagaacgaattccctacattgaaggttcaacatcaattgattgattctgccgccatgatcctagttaagaacccaacccacctaaatggtattataatcaccagcaacatgtttggtgatatcatctccgatgaagcctccgttatcccaggttccttgggtttgttgccatctgcgtccttggcctctttgccagacaagaacaccgcatttggtttgtacgaaccatgccacggttctgctccagatttgccaaagaataaggttgaccctatcgccactatcttgtctgctgcaatgatgttgaaattgtcattgaacttgcctgaagaaggtaaggccattgaagatgcagttaaaaaggttttggatgcaggtatcagaactggtgatttaggtggttccaacagtaccaccgaagtcggtgatgctgtcgccgaagaagttaagaaaatccttgcttaaaaagattctctttttttatgatatttgtacataaactttataaatgaaattcataatagaaacgacacgaaattacaaaatggaatatgttcatagggtagacgaaactatatacgcaatctacatacatttatcaagaaggagaaaaaggaggatagtaaaggaatacaggtaagcaaattgatactaatggctcaacgtgataaggaaaaagaattgcactttaacattaatattgacaaggaggagggcaccacacaaaaagttaggtgtaacagaaaatcatgaaactacgattcctaatttgatattggaggattttctctaaaaaaaaaaaaatacaacaaataaaaaacactcaatgacctgaccatttgatggagtttaagtcaataccttcttgaaccatttcccataatggtgaaagttccctcaagaattttactctgtcagaaacggccttacgacgtagtcgatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcga

SEQ ID NO: 180 - DNA, 8815 bp, Artificial Sequence
  Description of Artificial Sequence: Synthetic pDEST33 polynucleotide
gccttacgcatctgtgcggtatttcacaccgcaggcaagtgcacaaacaatacttaaataaatactactcagtaataacctatttcttagcatttttgacgaaatttgctattttgttagagtcttttacaccatttgtctccacacctccgcttacatcaacaccaataacgccatttaatctaagcgcatcaccaacattttctggcgtcagtccaccagctaacataaaatgtaagctttcggggctctcttgccttccaacccagtcagaaatcgagttccaatccaaaagttcacctgtcccacctgcttctgaatcaaacaagggaataaacgaatgaggtttctgtgaagctgcactgagtagtatgttgcagtcttttggaaatacgagtcttttaataactggcaaaccgaggaactcttggtattcttgccacgactcatctccatgcagttggacgatatcaatgccgtaatcattgaccagagccaaaacatcctccttaggttgattacgaaacacgccaaccaagtatttcggagtgcctgaactatttttatatgcttttacaagacttgaaattttccttgcaataaccgggtcaattgttctctttctattgggcacacatataatacccagcaagtcagcatcggaatctagagcacattctgcggcctctgtgctctgcaagccgcaaactttcaccaatggaccagaactacctgtgaaattaataacagacatactccaagctgcctttgtgtgcttaatcacgtatactcacgtgctcaatagtcaccaatgccctccctcttggccctctccttttcttttttcgaccgaattaattcttaatcggcaaaaaaagaaaagctccggatcaagattgtacgtaaggtgacaagctatttttcaataaagaatatcttccactactgccatctggcgtcataactgcaaagtacacatatattacgatgctgtctattaaatgcttcctatattatatatatagtaatgtcgtttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttaggacggatcgcttgcctgtaacttacacgcgcctcgtatcttttaatgatggaataatttgggaatttactctgtgtttatttatttttatgttttgtatttggattttagaaagtaaataaagaaggtagaagagttacggaatgaagaaaaaaaaataaacaaaggtttaaaaaatttcaacaaaaagcgtactttacatatatatttattagacaagaaaagcagattaaatagatatacattcgattaacgataagtaaaatgtaaaatcacaggattttcgtgtgtggtcttctacacagacaagatgaaacaattcggcattaatacctgagagcaggaagagcaagataaaaggtagtatttgttggcgatccccctagagtcttttacatcttcggaaaacaaaaactattttttctttaatttctttttttactttctatttttaatttatatatttatattaaaaaatttaaattataattatttttatagcacgtgatgaaaaggacccaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgctttttttcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacgggcagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccaggggggaacgcctggtatctttatagtcctgtcgggtttcgccacctctgacttgagcgtcgatttttgtgatgctcgtcaggggggccgagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttacctcactcattaggcaccccaggctttacactttatgcttccggctcctatgttgtgtggaattgtgagcggataacaatttcacacaggaaacagctatgaccatgattacgccaagctcggaattaaccctcactaaagggaacaaaagctgggtaccgggccccccctcgagatccgggatcgaagaaatgatggtaaatgaaataggaaatcaaggagcatgaaggcaaaagacaaatataagggtcgaacgaaaaataaagtgaaaagtgttgatatgatgtatttggctttgcggcgccgaaaaaacgagtttacgcaattgcacaatcatgctgactctgtggcggacccgcgctcttgccggcccggcgataacgctgggcgtgaggctgtgcccggcggagttttttgcgcctgcattttccaaggtttaccctgcgctaaggggcgagattggagaagcaataagaatgccggttggggttgcgatgatgacgaccacgacaactggtgtcattatttaagttgccgaaagaacctgagtgcatttgcaacatgagtatactagaagaatgagccaagacttgcgagacgcgagtttgccggtggtgcgaacaatagagcgaccatgaccttgaaggtgagacgcgcataaccgctagagtactttgaagaggaaacagcaatagggttgctaccagtataaatagacaggtacatacaacactggaaatggttgtctgtttgagtacgctttcaattcatttgggtgtgcactttattatgttacaatatggaagggaactttacacttctcctatgcacatatattaattaaagtccaatgctagtagagaaggggggtaacacccctccgcgctcttttccgatttttttctaaaccgtggaatatttcggatatccttttgttgtttccgggtgtacaatatggacttcctcttttctggcaaccaaacccatacatcgggattcctataataccttcgttggtctccctaacatgtaggtggcggaggggagatatacaatagaacagataccagacaagacataatgggctaaacaagactacaccaattacactgcctcattgatggtggtacataacgaactaatactgtagccctagacttgatagccatcatcatatcgaagtttcactaccctttttccatttgccatctattgaagtaataataggcgcatgcaacttcttttctttttttttcttttctctctcccccgttgttgtctcaccatatccgcaatgacaaaaaaaatgatggaagacactaaaggaaaaaattaacgacaaagacagcaccaacagatgtcgttgttccagagctgatgaggggtatcttcgaacacacgaaactttttccttccttcattcacgcacactactctctaatgagcaacggtatacggccttccttccagttacttgaatttgaaataaaaaaagtttgccgctttgctatcaagtataaatagacctgcaattattaatcttttgtttcctcgtcattgttctcgttccctttcttccttgtttctttttctgcacaatatttcaagctataccaagcatacaatcaactccaagcttatgcccaagaagaagcggaaggtctcgagcggcgccaattttaatcaaagtgggaatattgctgatagctcattgtccttcactttcactaacagtagcaacggtccgaacctcataacaactcaaacaaattctcaagcgctttcacaaccaattgcctcctctaacgttcatgataacttcatgaataatgaaatcacggctagtaaaattgatgatggtaataattcaaaaccactgtcacctggttggacggaccaaactgcgtataacgcgtttggaatcactacagggatgtttaataccactacaatggatgatgtatataactatctattcgatgatgaagataccccaccaaacccaaaaaaagagggtgggtcgaatcaaacaagtttgtacaaaaaagctgaacgagaaacgtaaaatgatataaatatcaatatattaaattagattttgcataaaaaacagactacataatactgtaaaacacaacatatccagtcactatggcggccgctaagttggcagcatcacccgacgcactttgcgccgaataaatacctgtgacggaagatcacttcgcagaataaataaatcctggtgtccctgttgataccgggaagccctgggccaacttttggcgaaaatgagacgttgatcggcacgtaagaggttccaactttcaccataatgaaataagatcactaccgggcgtattttttgagttatcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtctgtgatggcttccatgtcggcagaatgcttaatgaattacaacagtactgcgatgagtggcagggcggggcgtaatctagaggatccggcttactaaaagccagataacagtatgcgtatttgcgcgctgatttttgcggtataagaatatatactgatatgtatacccgaagtatgtcaaaaagaggtgtgctatgaagcagcgtattacagtgacagttgacagcgacagctatcagttgctcaaggcatatatgatgtcaatatctccggtctggtaagcacaaccatgcagaatgaagcccgtcgtctgcgtgccgaacgctggaaagcggaaaatcaggaagggatggctgaggtcgcccggtttattgaaatgaacggctcttttgctgacgagaacagggactggtgaaatgcagtttaaggtttacacctataaaagagagagccgttatcgtctgtttgtggatgtacagagtgatattattgacacgcccgggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatataaatgtcaggctccgttatacacagccagtctgcaggtcgaccatagtgactggatatgttgtgttttacagtattatgtagtctgttttttatgcaaaatctaatttaatatattgatatttatatcattttacgtttctcgttcagctttcttgtacaaagtggtttgatggccgctaagtaagtaagacgtcgagctccctatagtgagtcgtattacactggccgtcgttttacaacgtcgtgactgggaaaacaccggtgagctctaagtaagtaacggccgccaccgcggtggagctttggacttcttcgccagaggtttggtcaagtctccaatcaaggttgtcggcttgtctaccttgccagaaatttacgaaaagatggaaaagggtcaaatcgttggtagatacgttgttgacacttctaaataagcgaatttcttatgatttatgatttttattattaaataagttataaaaaaaataagtgtatacaaattttaaagtgactcttaggttttaaaacgaaaattcttgttcttgagtaactctttcctgtaggtcaggttgctttctcaggtatagcatgaggtcgctcttattgaccacacctctaccggcatgccgagcaaatgcctgcaaatcgctccccatttcacccaattgtagatatgctaactccagcaatgagttgatgaatctcggtgtgtattttatgtcctcagaggacaatacctgttgtaatcgttcttccacacggatccgcatcaggcgaaattgtaaacgttaatattttgttaaaattcgcgttaaatatttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcactgca

SEQ ID NO: 181 - DNA, 7114 bp, Artificial Sequence
  Description of Artificial Sequence: Synthetic pDEST34 polynucleotide
atcgagatctcgatcccgcgaaattaatacgactcactatagggagaccacaacggtttccctctagatcacaagtttgtacaaaaaagctgaacgagaaacgtaaaatgatataaatatcaatatattaaattagattttgcataaaaaacagactacataatactgtaaaacacaacatatccagtcactatggcggccgcattaggcaccccaggctttacactttatgcttccggctcgtataatgtgtggattttgagttaggatccggcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtctgtgatggcttccatgtcggcagaatgcttaatgaattacaacagtactgcgatgagtggcagggcggggcgtaaacgcgtggatccggcttactaaaagccagataacagtatgcgtatttgcgcgctgatttttgcggtataagaatatatactgatatgtatacccgaagtatgtcaaaaagaggtgtgctatgaagcagcgtattacagtgacagttgacagcgacagctatcagttgctcaaggcatatatgatgtcaatatctccggtctggtaagcacaaccatgcagaatgaagcccgtcgtctgcgtgccgaacgctggaaagcggaaaatcaggaagggatggctgaggtcgcccggtttattgaaatgaacggctcttttgctgacgagaacagggactggtgaaatgcagtttaaggtttacacctataaaagagagagccgttatcgtctgtttgtggatgtacagagtgatattattgacacgcccgggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatataaatgtcaggctcccttatacacagccagtctgcaggtcgaccatagtgactggatatgttgtgttttacagtattatgtagtctgttttttatgcaaaatctaatttaatatattgatatttatatcattttacgtttctcgttcagctttcttgtacaaagtggtgattatgtcccctatactaggttattggaaaattaagggccttgtgcaacccactcgacttcttttggaatatcttgaagaaaaatatgaagagcatttgtatgagcgcgatgaaggtgataaatggcgaaacaaaaagtttgaattgggtttggagtttcccaatcttccttattatattgatggtgatgttaaattaacacagtctatggccatcatacgttatatagctgacaagcacaacatgttgggtggttgtccaaaagagcgtgcagagatttcaatgcttgaaggagcggttttggatattagatacggtgtttcgagaattgcatatagtaaagactttgaaactctcaaagttgattttcttagcaagctacctgaaatgctgaaaatgttcgaagatcgtttatgtcataaaacatatttaaatggtgatcatgtaacccatcctgacttcatgttgtatgacgctcttgatgttgttttatacatggacccaatgtgcctggatgcgttcccaaaattagtttgttttaaaaaacgtattgaagctatcccacaaattgataagtacttgaaatccagcaagtatatagcatggcctttgcagggctggcaagccacgtttggtggtggcgaccatcctccaaaatcggatctggttccgcgtccatggggatccggctgctaacaaagcccgaaaggaagctgagttggctgctgccaccgctgagcgcttcccgataagggagcaggccagtaaaagcattacccgtggtggggttcccgagcggccaaagggagcagactctaaatctgccgtcatcgacttcgaaggttcgaatccttcccccaccaccatcactttcaaaagtgaattcgctgagcaataactagcataaccccttggggcctctaaacgggtcttgaggggttttttgctgaaaggaggaactatatccggatatccacaggacgggtgtggtcgccatgatcgcgtagtcgatagtggctccaagtagcgaagcgagcaggactgggcggcggccaaagcggtcggacagtgctccgagaacgggtgcgcatagaaattgcatcaacgcatatagcgctagcagcacgccatagtgactggcgatgctgtcggaatggacgatatcccgcaagaggcccggcagtaccggcataaccaagcctatgcctacagcatccagggtgacggtgccgaggatgacgatgagcgcattgttagatttcatacacggtgcctgactgcgttagcaatttaactgtgataaactaccgcattaaagcttatcgatgataagctgtcaaacatgagaattcttgaagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagctgcggtaaagctcatcagcgtggtcgtgaagcgattcacagatgtctgcctgttcatccgcgtccagctcgttgagtttctccagaagcgttaatgtctggcttctgataaagcgggccatgttaagggcggttttttcctgtttggtcactgatgcctccgtgtaagggggatttctgttcatgggggtaatgataccgatgaaacgagagaggatgctcacgatacgggttactgatgatgaacatgcccggttactggaacgttgtgagggtaaacaactggcggtatggatgcggcgggaccagagaaaaatcactcagggtcaatgccagcgcttcgttaatacagatgtaggtgttccacagggtagccagcagcatcctgcgatgcagatccggaacataatggtgcagggcgctgacttccgcgtttccagactttacgaaacacggaaaccgaagaccattcatgttgttgctcaggtcgcagacgttttgcagcagcagtcgcttcacgttcgctcgcgtatcggtgattcattctgctaaccagtaaggcaaccccgccagcctagccgggtcctcaacgacaggagcacgatcatgcgcacccgtggccaggacccaacgctgcccgagatgcgccgcgtgcggctgctggagatggcggacgcgatggatatgttctgccaagggttggtttgcgcattcacagttctccgcaagaattgattggctccaattcttggagtggtgaatccgttagcgaggtgccgccggcttccattcaggtcgaggtggcccggctccatgcaccgcgacgcaacgcggggaggcagacaaggtatagggcggcgcctacaatccatgccaacccgttccatgtgctcgccgaggcggcataaatcgccgtgacgatcagcggtccagtgatcgaagttaggctggtaagagccgcgagcgatccttgaagctgtccctgatggtcgtcatctacctgcctggacagcatggcctgcaacgcgggcatcccgatgccgccggaagcgagaagaatcataatggggaaggccatccagcctcgcgtcgcgaacgccagcaagacgtagcccagcgcgtcggccgccatgccggcgataatggcctgcttctcgccgaaacgtttggtggcgggaccagtgacgaaggcttgagcgagggcgtgcaagattccgaataccgcaagcgacaggccgatcatcgtcgcgctccagcgaaagcggtcctcgccgaaaatgacccagagcgctgccggcacctgtcctacgagttgcatgataaagaagacagtcataagtgcggcgacgatagtcatgccccgcgcccaccggaaggagctgactgggttgaaggctctcaagggcatcggtcgatcgacgctctcccttatgcgactcctgcattaggaagcagcccagtagtaggttgaggccgttgagcaccgccgccgcaaggaatggtgcatgcaaggagatggcgcccaacagtcccccggccacggggcctgccaccatacccacgccgaaacaagcgctcatgagcccgaagtggcgagcccgatcttccccatcggtgatgtcggcgatataggcgccagcaaccgcacctgtggcgccggtgatgccggccacgatgcgtccggcgtagagg

SEQ ID NO: 182 - DNA, 5584 bp, Artificial Sequence
  Description of Artificial Sequence: Synthetic pDONR207 polynucleotide
gcgagagtagggaactgccaggcatcaaataaaacgaaaggctcagtcggaagactgggcctttcgttttatctgttgtttgtcggtgaacgctctcctgagtaggacaaatccgccgggagcggatttgaacgttgtgaagcaacggcccggagggtggcgggcaggacgcccgccataaactgccaggcatcaaactaagcagaaggccatcctgacggatggcctttttgcgtttctacaaactcttcctggctagcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagcttgcgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattagtagccaaccactagaactatagctagagtcctgggcgaacaaacgatgctcgccttccagaaaaccgaggatgcgaaccacttcatccggggtcagcaccaccggcaagcgccgcgacggccgaggtcttccgatctcctgaagccagggcagatccgtgcacagcaccttgccgtagaagaacagcaaggccgccaatgcctgacgatgcgtggagaccgaaaccttgcgctcgttcgccagccaggacagaaatgcctcgacttcgctgctgcccaaggttgccgggtgacgcacaccgtggaaacggatgaaggcacgaacccagttgacataagcctgttcggttcgtaaactgtaatgcaagtagcgtatgcgctcacgcaactggtccagaaccttgaccgaacgcagcggtggtaacggcgcagtggcggttttcatggcttgttatgactgtttttttgtacagtctatgcctcgggcatccaagcagcaagcgcgttacgccgtgggtcgatgtttgatgttatggagcagcaacgatgttacgcagcagcaacgatgttacgcagcagggcagtcgccctaaaacaaagttaggtggctcaagtatgggcatcattcgcacatgtaggctcggccctgaccaagtcaaatccatgcgggctgctcttgatcttttcggtcgtgagttcggagacgtagccacctactcccaacatcagccggactccgattacctcgggaacttgctccgtagtaagacattcatcgcgcttgctgccttcgaccaagaagcggttgttggcgctctcgcggcttacgttctgcccaggtttgagcagccgcgtagtgagatctatatctatgatctcgcagtctccggcgagcaccggaggcagggcattgccaccgcgctcatcaatctcctcaagcatgaggccaacgcgcttggtgcttatgtgatctacgtgcaagcagattacggtgacgatcccgcagtggctctctatacaaagttgggcatacgggaagaagtgatgcactttgatatcgacccaagtaccgccacctaacaattcgttcaagccgagatcggcttcccggcctaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgtttttccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaagcgatagattgtcgcacctgattgcccgacattatcgcgagcccatttatacccatataaatcagcatccatgttggaatttaatcgcggcctcgacgtttcccgttgaatatggctcataacaccccctgtattactgtttatgtaagcagacagttttattgttcatgatgatatatttttatcttgtgcaatgtaacatcagagattttgagacacgggccagagctgcagctggatggcaaataatgattttattttgactgatagtgacctgttcgttgcaacaaattgataagcaatgctttcttataatgccaactttgtacaagaaagctgaacgagaaacgtaaaatgatataaatatcaatatattaaattagattttgcataaaaaacagactacataatactgtaaaacacaacatatccagtcactatgaatcaactacttagatggtattagtgacctgtagtcgactaagttggcagcatcacccgacgcactttgcgccgaataaatacctgtgacggaagatcacttcgcagaataaataaatcctggtgtccctgttgataccgggaagccctgggccaactttggcgaaaatgagacgttgatcggcacgtaagaggttccaactttcaccataatgaaataagatcactaccgggcgtattttttgagttatcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtctgtgatggcttccatgtcggcagaatgcttaatgaattacaacagtactgcgatgagtggcagggcggggcgtaatcgcgtggatccggcttactaaaagccagataacagtatgcgtatttgcgcgctgatttttgcggtataagaatatatactgatatgtatacccgaagtatgtcaaaaagaggtgtgctatgaagcagcgtattacagtgacagttgacagcgacagctatcagttgctcaaggcatatatgatgtcaatatctccggtctggtaagcacaaccatgcagaatgaagcccgtcgtctgcgtgccgaacgctggaaagcggaaaatcaggaagggatggctgaggtcgcccggtttattgaaatgaacggctcttttgctgacgagaacagggactggtgaaatgcagtttaaggtttacacctataaaagagagagccgttatcgtctgtttgtggatgtacagagtgatattattgacacgcccgggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatataaatgtcaggctcccttatacacagccagtctgcaggtcgatacagtagaaattacagaaactttatcacgtttagtaagtatagaggctgaaaatccagatgaagccgaacgacttgtaagagaaaagtataagagttgtgaaattgttcttgatgcagatgattttcaggactatgacactagcgtatatgaataggtagatgtttttattttgtcacacaaaaaagaggctcgcacctctttttcttatttctttttatgatttaatacggcattgaggacaatagcgagtaggctggatacgacgattccgtttgagaagaacatttggaaggctgtcggtcgactaagttggcagcatcacccgaagaacatttggaaggctgtcggtcgactacaggtcactaataccatctaagtagttgattcatagtgactggatatgttgtgttttacagtattatgtagtctgttttttatgcaaaatctaatttaatatattgatatttatatcattttacgtttctcgttcagcttttttgtacaaagttggcattataaaaaagcattgctcatcaatttgttgcaacgaacaggtcactatcagtcaaaataaaatcattatttggggcccgagatccatgctagcgttaac

SEQ ID NO: 183 - DNA, 7038 bp, Artificial Sequence
  Description of Artificial Sequence: Synthetic pMAB85 polynucleotide
gccttacgcatctgtgcggtatttcacaccgcaggcaagtgcacaaacaatacttaaataaatactactcagtaataacctatttcttagcatttttgacgaaatttgctattttgttagagtcttttacaccatttgtctccacacctccgcttacatcaacaccaataacgccatttaatctaagcgcatcaccaacattttctggcgtcagtccaccagctaacataaaatgtaagctttcggggctctcttgccttccaacccagtcagaaatcgagttccaatccaaaagttcacctgtcccacctgcttctgaatcaaacaagggaataaacgaatgaggtttctgtgaagctgcactgagtagtatgttgcagtcttttggaaatacgagtcttttaataactggcaaaccgaggaactcttggtattcttgccacgactcatctccatgcagttggacgatatcaatgccgtaatcattgaccagagccaaaacatcctccttaggttgattacgaaacacgccaaccaagtatttcggagtgcctgaactatttttatatgcttttacaagacttgaaattttccttgcaataaccgggtcaattgttctctttctattgggcacacatataatacccagcaagtcagcatcggaatctagagcacattctgcggcctctgtgctctgcaagccgcaaactttcaccaatggaccagaactacctgtgaaattaataacagacatactccaagctgcctttgtgtgcttaatcacgtatactcacgtgctcaatagtcaccaatgccctccctcttggccctctccttttcttttttcgaccgaattaattcttaatcggcaaaaaaagaaaagctccggatcaagattgtacgtaaggtgacaagctatttttcaataaagaatatcttccactactgccatctggcgtcataactgcaaagtacacatatattacgatgctgtctattaaatgcttcctatattatatatatagtaatgtcgtttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttaggacggatcgcttgcctgtaacttacacgcgcctcgtatcttttaatgatggaataatttgggaatttactctgtgtttatttatttttatgttttgtatttggattttagaaagtaaataaagaaggtagaagagttacggaatgaagaaaaaaaaataaacaaaggtttaaaaaatttcaacaaaaagcgtactttacatatatatttattagacaagaaaagcagattaaatagatatacattcgattaacgataagtaaaatgtaaaatcacaggattttcgtgtgtggtcttctacacagacaagatgaaacaattcggcattaatacctgagagcaggaagagcaagataaaaggtagtatttgttggcgatccccctagagtcttttacatcttcggaaaacaaaaactattttttctttaatttctttttttactttctatttttaatttatatatttatattaaaaaatttaaattataattatttttatagcacgtgatgaaaaggacccaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgctttttttcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacgggcagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccaggggggaacgcctggtatctttatagtcctgtcgggtttcgccacctctgacttgagcgtcgatttttgtgatgctcgtcaggggggccgagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttacctcactcattaggcaccccaggctttacactttatgcttccggctcctatgttgtgtggaattgtgagcggataacaatttcacacaggaaacagctatgaccatgattacgccaagctcggaattaaccctcactaaagggaacaaaagctgggtaccgggccccccctcgagatccgggatcgaagaaatgatggtaaatgaaataggaaatcaaggagcatgaaggcaaaagacaaatataagggtcgaacgaaaaataaagtgaaaagtgttgatatgatgtatttggctttgcggcgccgaaaaaacgagtttacgcaattgcacaatcatgctgactctgtggcggacccgcgctcttgccggcccggcgataacgctgggcgtgaggctgtgcccggcggagttttttgcgcctgcattttccaaggtttaccctgcgctaaggggcgagattggagaagcaataagaatgccggttggggttgcgatgatgacgaccacgacaactggtgtcattatttaagttgccgaaagaacctgagtgcatttgcaacatgagtatactagaagaatgagccaagacttgcgagacgcgagtttgccggtggtgcgaacaatagagcgaccatgaccttgaaggtgagacgcgcataaccgctagagtactttgaagaggaaacagcaatagggttgctaccagtataaatagacaggtacatacaacactggaaatggttgtctgtttgagtacgctttcaattcatttgggtgtgcactttattatgttacaatatggaagggaactttacacttctcctatgcacatatattaattaaagtccaatgctagtagagaaggggggtaacacccctccgcgctcttttccgatttttttctaaaccgtggaatatttcggatatccttttgttgtttccgggtgtacaatatggacttcctcttttctggcaaccaaacccatacatcgggattcctataataccttcgttggtctccctaacatgtaggtggcggaggggagatatacaatagaacagataccagacaagacataatgggctaaacaagactacaccaattacactgcctcattgatggtggtacataacgaactaatactgtagccctagacttgatagccatcatcatatcgaagtttcactaccctttttccatttgccatctattgaagtaataataggcgcatgcaacttcttttctttttttttcttttctctctcccccgttgttgtctcaccatatccgcaatgacaaaaaaaatgatggaagacactaaaggaaaaaattaacgacaaagacagcaccaacagatgtcgttgttccagagctgatgaggggtatcttcgaacacacgaaactttttccttccttcattcacgcacactactctctaatgagcaacggtatacggccttccttccagttacttgaatttgaaataaaaaaagtttgccgctttgctatcaagtataaatagacctgcaattattaatcttttgtttcctcgtcattgttctcgttccctttcttccttgtttctttttctgcacaatatttcaagctataccaagcatacaatcaactccaagcttatgcccaagaagaagcggaaggtctcgagcggcgccaattttaatcaaagtgggaatattgctgatagctcattgtccttcactttcactaacagtagcaacggtccgaacctcataacaactcaaacaaattctcaagcgctttcacaaccaattgcctcctctaacgttcatgataacttcatgaataatgaaatcacggctagtaaaattgatgatggtaataattcaaaaccactgtcacctggttggacggaccaaactgcgtataacgcgtttggaatcactacagggatgtttaataccactacaatggatgatgtatataactatctattcgatgatgaagataccccaccaaacccaaaaaaagagggtgggtcgatcacaagtttgtacaaaaaagcaggcttgtcgaccccgggaattcagatctactagtgcggccgcacgcgtacccagctttcttgtacaaagtggtgacgtcgagctccctatagtgagtcgtattacactggccgtcgttttacaacgtcgtgactgggaaaacaccggtgagctctaagtaagtaacggccgccaccgcggtggagctttggacttcttcgccagaggtttggtcaagtctccaatcaaggttgtcggcttgtctaccttgccagaaatttacgaaaagatggaaaagggtcaaatcgttggtagatacgttgttgacacttctaaataagcgaatttcttatgatttatgatttttattattaaataagttataaaaaaaataagtgtatacaaattttaaagtgactcttaggttttaaaacgaaaattcttgttcttgagtaactctttcctgtaggtcaggttgctttctcaggtatagcatgaggtcgctcttattgaccacacctctaccggcatgccgagcaaatgcctgcaaatcgctccccatttcacccaattgtagatatgctaactccagcaatgagttgatgaatctcggtgtgtattttatgtcctcagaggacaatacctgttgtaatcgttcttccacacggatccgcatcaggcgaaattgtaaacgttaatattttgttaaaattcgcgttaaatatttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcactgca

SEQ ID NO: 184 - DNA, 7146 bp, Artificial Sequence
  Description of Artificial Sequence: Synthetic pMAB86 polynucleotide
gacgaaagggcctcgtgatacgcctatttttataggttaatgtcatgataataatggtttcttaggacggatcgcttgcctgtaacttacacgcgcctcgtatcttttaatgatggaataatttgggaatttactctgtgtttatttatttttatgttttgtatttggattttagaaagtaaataaagaaggtagaagagttacggaatgaagaaaaaaaaataaacaaaggtttaaaaaatttcaacaaaaagcgtactttacatatatatttattagacaagaaaagcagattaaatagatatacattcgattaacgataagtaaaatgtaaaatcacaggattttcgtgtgtggtcttctacacagacaagatgaaacaattcggcattaatacctgagagcaggaagagcaagataaaaggtagtatttgttggcgatccccctagagtcttttacatcttcggaaaacaaaaactattttttctttaatttctttttttactttctatttttaatttatatatttatattaaaaaatttaaattataattatttttatagcacgtgatgaaaaggacccaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgctttttttcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacgggcagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccaggggggaacgcctggtatctttatagtcctgtcgggtttcgccacctctgacttgagcgtcgatttttgtgatgctcgtcaggggggccgagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttacctcactcattaggcaccccaggctttacactttatgcttccggctcctatgttgtgtggaattgtgagcggataacaatttcacacaggaaacagctatgaccatgattacgccaagctcggaattaaccctcactaaagggaacaaaagctgggtaccgggccccccctcgagatccgggatcgaagaaatgatggtaaatgaaataggaaatcaaggagcatgaaggcaaaagacaaatataagggtcgaacgaaaaataaagtgaaaagtgttgatatgatgtatttggctttgcggcgccgaaaaaacgagtttacgcaattgcacaatcatgctgactctgtggcggacccgcgctcttgccggcccggcgataacgctgggcgtgaggctgtgcccggcggagttttttgcgcctgcattttccaaggtttaccctgcgctaaggggcgagattggagaagcaataagaatgccggttggggttgcgatgatgacgaccacgacaactggtgtcattatttaagttgccgaaagaacctgagtgcatttgcaacatgagtatactagaagaatgagccaagacttgcgagacgcgagtttgccggtggtgcgaacaatagagcgaccatgaccttgaaggtgagacgcgcataaccgctagagtactttgaagaggaaacagcaatagggttgctaccagtataaatagacaggtacatacaacactggaaatggttgtctgtttgagtacgctttcaattcatttgggtgtgcactttattatgttacaatatggaagggaactttacacttctcctatgcacatatattaattaaagtccaatgctagtagagaaggggggtaacacccctccgcgctcttttccgatttttttctaaaccgtggaatatttcggatatccttttgttgtttccgggtgtacaatatggacttcctcttttctggcaaccaaacccatacatcgggattcctataataccttcgttggtctccctaacatgtaggtggcggaggggagatatacaatagaacagataccagacaagacataatgggctaaacaagactacaccaattacactgcctcattgatggtggtacataacgaactaatactgtagccctagacttgatagccatcatcatatcgaagtttcactaccctttttccatttgccatctattgaagtaataataggcgcatgcaacttcttttctttttttttcttttctctctcccccgttgttgtctcaccatatccgcaatgacaaaaaaaatgatggaagacactaaaggaaaaaattaacgacaaagacagcaccaacagatgtcgttgttccagagctgatgaggggtatcttcgaacacacgaaactttttccttccttcattcacgcacactactctctaatgagcaacggtatacggccttccttccagttacttgaatttgaaataaaaaaagtttgccgctttgctatcaagtataaatagacctgcaattattaatcttttgtttcctcgtcattgttctcgttccctttcttccttgtttctttttctgcacaatatttcaagctataccaagcatacaatcaactccaagcttatgcccaagaagaagcggaaggtctcgagcggcgccaattttaatcaaagtgggaatattgctgatagctcattgtccttcactttcactaacagtagcaacggtccgaacctcataacaactcaaacaaattctcaagcgctttcacaaccaattgcctcctctaacgttcatgataacttcatgaataatgaaatcacggctagtaaaattgatgatggtaataattcaaaaccactgtcacctggttggacggaccaaactgcgtataacgcgtttggaatcactacagggatgtttaataccactacaatggatgatgtatataactatctattcgatgatgaagataccccaccaaacccaaaaaaagagggtgggtcgatcacaagtttgtacaaaaaagcaggcttgtcgaccccgggaattcagatctactagtgcggccgcacgcgtacccagctttcttgtacaaagtggtgacgtcgagctctaagtaagtaacggccgccaccgcggtggagctttggacttcttcgccagaggtttggtcaagtctccaatcaaggttgtcggcttgtctaccttgccagaaatttacgaaaagatggaaaagggtcaaatcgttggtagatacgttgttgacacttctaaataagcgaatttcttatgatttatgatttttattattaaataagttataaaaaaaataagtgtatacaaattttaaagtgactcttaggttttaaaacgaaaattcttgttcttgagtaactctttcctgtaggtcaggttgctttctcaggtatagcatgaggtcgctcttattgaccacacctctaccggcatgccgagcaaatgcctgcaaatcgctccccatttcacccaattgtagatatgctaactccagcaatgagttgatgaatctcggtgtgtattttatgtcctcagaggacaatacctgttgtaatcgttcttccacacggatcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcctgatgcggtattttctccttacgcatctgtgcggtatttcacaccgcaggcaagtgcacaaacaatacttaaataaatactactcagtaataacctatttcttagcatttttgacgaaatttgctattttgttagagtcttttacaccatttgtctccacacctccgcttacatcaacaccaataacgccatttaatctaagcgcatcaccaacattttctggcgtcagtccaccagctaacataaaatgtaagctttcggggctctcttgccttccaacccagtcagaaatcgagttccaatccaaaagttcacctgtcccacctgcttctgaatcaaacaagggaataaacgaatgaggtttctgtgaagctgcactgagtagtatgttgcagtcttttggaaatacgagtcttttaataactggcaaaccgaggaactcttggtattcttgccacgactcatctccatgcagttggacgatatcaatgccgtaatcattgaccagagccaaaacatcctccttaggttgattacgaaacacgccaaccaagtatttcggagtgcctgaactatttttatatgcttttacaagacttgaaattttccttgcaataaccgggtcaattgttctctttctattgggcacacatataatacccagcaagtcagcatcggaatctagagcacattctgcggcctctgtgctctgcaagccgcaaactttcaccaatggaccagaactacctgtgaaattaataacagacatactccaagctgcctttgtgtgcttaatcacgtatactcacgtgctcaatagtcaccaatgccctccctcttggccctctccttttcttttttcgaccgaattaattcttaatcggcaaaaaaagaaaagctccggatcaagattgtacgtaaggtgacaagctatttttcaataaagaatatcttccactactgccatctggcgtcataactgcaaagtacacatatattacgatgctgtctattaaatgcttcctatattatatatatagtaatgtcgtttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcga

SEQ ID NO: 185 - DNA, 64 bp, Artificial Sequence
  Description of Artificial Sequence: Synthetic pENTR1A multiple cloning site oligonucleotide
  CDS (1)..(63)
actttgtacaaaaaagcaggctttaaaggaaccaattcagtcgactggatccggtaccgaattc

SEQ ID NO: 186 - protein, 21 aa, Artificial Sequence
  Description of Artificial Sequence: Synthetic pENTR1A multiple cloning site peptide
TLYKKAGFKGTNSVDWIRYRI

SEQ ID NO: 187 - DNA, 49 bp, Artificial Sequence
  Description of Artificial Sequence: Synthetic pENTR1A multiple cloning site oligonucleotide
gaattcgcggccgcactcgagatatctagacccagctttcttgtacaaa

SEQ ID NO: 188 - DNA, 62 bp, Artificial Sequence
  Description of Artificial Sequence: Synthetic pENTR2B multiple cloning site oligonucleotide
  CDS (1)..(60)
ttgtacaaaaaagcaggctggcgccggaaccaattcagtcgactggatccggtaccgaattc

SEQ ID NO: 189 - protein, 20 aa, Artificial Sequence
  Description of Artificial Sequence: Synthetic pENTR2B multiple cloning site peptide
LYKKAGWRRNQFSRLDPVPN

SEQ ID NO: 190 - DNA, 50 bp, Artificial Sequence
  Description of Artificial Sequence: Synthetic pENTR2B multiple cloning site oligonucleotide
  CDS (2)..(49)
gaattcgcggccgcactcgagatatctagacccagctttcttgtacaaag

SEQ ID NO: 191 - protein, 16 aa, Artificial Sequence
  Description of Artificial Sequence: Synthetic pENTR2B multiple cloning site peptide
NSRPHSRYLDPAFLYK

SEQ ID NO: 192 - DNA, 69 bp, Artificial Sequence
  Description of Artificial Sequence: Synthetic pENTR3C multiple cloning site oligonucleotide
  CDS (1)..(63)
ttgtacaaaaaagcaggctctttaaaggaaccaattcagtcgactggatccggtaccgaattcgatcgc

SEQ ID NO: 193 - protein, 21 aa, Artificial Sequence
  Description of Artificial Sequence: Synthetic pENTR3C multiple cloning site peptide
LYKKAGSLKEPIQSTGSGTEF

SEQ ID NO: 194 - DNA, 50 bp, Artificial Sequence; identical to SEQ ID NO: 190
  Description of Artificial Sequence: Synthetic pENTR3C multiple cloning site oligonucleotide
  CDS (2)..(49)

SEQ ID NO: 195 - protein, 16 aa, Artificial Sequence
  Description of Artificial Sequence: Synthetic pENTR3C multiple cloning site peptide
NSRPHSRYLDPAFLYK

SEQ ID NO: 196 - DNA, 64 bp, Artificial Sequence
  Description of Artificial Sequence: Synthetic pENTR4 multiple cloning site oligonucleotide
  CDS (1)..(63)
ttgtacaaaaaagcaggctccaccatgggaaccaattcagtcgactggatccggtaccgaattc

SEQ ID NO: 197 - protein, 21 aa, Artificial Sequence
  Description of Artificial Sequence: Synthetic pENTR4 multiple cloning site peptide
LYKKAGSTMGTNSVDWIRYRI

SEQ ID NO: 198 - DNA, 50 bp, Artificial Sequence; identical to SEQ ID NO: 190
  Description of Artificial Sequence: Synthetic pENTR4 multiple cloning site oligonucleotide
  CDS (2)..(49)

SEQ ID NO: 199 - protein, 16 aa, Artificial Sequence
  Description of Artificial Sequence: Synthetic pENTR4 multiple cloning site peptide
NSRPHSRYLDPAFLYK

SEQ ID NO: 200 - DNA, 66 bp, Artificial Sequence
  Description of Artificial Sequence: Synthetic pENTR5 multiple cloning site oligonucleotide
  CDS (1)..(63)
ttgtacaaaaaagcaggctttcatatgggaaccaattcagtcgactggatccggtaccgaattcgc

SEQ ID NO: 201 - protein, 21 aa, Artificial Sequence
  Description of Artificial Sequence: Synthetic pENTR5 multiple cloning site peptide
LYKKAGFHMGTNSVDWIRYRI

SEQ ID NO: 202 - DNA, 51 bp, Artificial Sequence
  Description of Artificial Sequence: Synthetic pENTR5 multiple cloning site oligonucleotide
agaattcgcggccgcactcgagatatctagacccagctttcttgtacaaag

SEQ ID NO: 203 - DNA, 63 bp, Artificial Sequence
  Description of Artificial Sequence: Synthetic pENTR6 multiple cloning site oligonucleotide
  CDS (1)..(60)
ttgtacaaaaaagcaggctgcatgcgaaccaattcagtcgactggatccggtaccgaattcgc

SEQ ID NO: 204 - protein, 20 aa, Artificial Sequence
  Description of Artificial Sequence: Synthetic pENTR6 multiple cloning site peptide
LYKKAGCMRTNSVDWIRYRI

SEQ ID NO: 205 - DNA, 51 bp, Artificial Sequence; identical to SEQ ID NO: 202
  Description of Artificial Sequence: Synthetic pENTR6 multiple cloning site oligonucleotide

SEQ ID NO: 206 - DNA, 84 bp, Artificial Sequence
  Description of Artificial Sequence: Synthetic pENTR7 multiple cloning site oligonucleotide
  CDS (1)..(81)
ttgtacaaaaaagcaggctttgaaaacctgtattttcaaggaaccgtttcatgcatcgtcgactggatccggtaccgaattcgc

SEQ ID NO: 207 - protein, 27 aa, Artificial Sequence
  Description of Artificial Sequence: Synthetic pENTR7 multiple cloning site peptide
LYKKAGFENLYFQGTVSCIVDWIRYRI

SEQ ID NO: 208 - DNA, 51 bp, Artificial Sequence; identical to SEQ ID NO: 202
  Description of Artificial Sequence: Synthetic pENTR7 multiple cloning site oligonucleotide

SEQ ID NO: 209 - DNA, 81 bp, Artificial Sequence
  Description of Artificial Sequence: Synthetic pENTR8 multiple cloning site oligonucleotide
  CDS (1)..(78)
ttgtacaaaaaagcaggctttgaaaacctgtattttcaaggaaccatggacctagtcgactggatccggtaccgaattcgc

SEQ ID NO: 210 - protein, 26 aa, Artificial Sequence
  Description of Artificial Sequence: Synthetic pENTR8 multiple cloning site peptide
LYKKAGFENLYFQGTMDLVDWIRYRI

SEQ ID NO: 211 - DNA, 51 bp, Artificial Sequence; identical to SEQ ID NO: 202
  Description of Artificial Sequence: Synthetic pENTR8 multiple cloning site oligonucleotide

SEQ ID NO: 212 - DNA, 81 bp, Artificial Sequence
  Description of Artificial Sequence: Synthetic pENTR9 multiple cloning site oligonucleotide
  CDS (1)..(78)
ttgtacaaaaaagcaggctttgaaaacctgtattttcaaggacatatgagatctgtcgactggatccggtaccgaattcgc

SEQ ID NO: 213 - protein, 26 aa, Artificial Sequence
  Description of Artificial Sequence: Synthetic pENTR9 multiple cloning site peptide
LYKKAGFENLYFQGHMRSVDWIRYRI

SEQ ID NO: 214 - DNA, 51 bp, Artificial Sequence; identical to SEQ ID NO: 202
  Description of Artificial Sequence: Synthetic pENTR9 multiple cloning site oligonucleotide

SEQ ID NO: 215 - DNA, 84 bp, Artificial Sequence
  Description of Artificial Sequence: Synthetic pENTR10 multiple cloning site oligonucleotide
  CDS (1)..(81)
ttgtacaaaaaagcaggcttcgaactaaggaaatacttacatatgggaaccaattcagtcgactggatccggtaccgaattcgc

SEQ ID NO: 216 - protein, 27 aa, Artificial Sequence
  Description of Artificial Sequence: Synthetic pENTR10 multiple cloning site peptide
LYKKAGFELRKYLHMGTNSVDWIRYRI

SEQ ID NO: 217 - DNA, 51 bp, Artificial Sequence; identical to SEQ ID NO: 202
  Description of Artificial Sequence: Synthetic pENTR10 multiple cloning site oligonucleotide

SEQ ID NO: 218 - DNA, 88 bp, Artificial Sequence
  Description of Artificial Sequence: Synthetic pENTR11 multiple cloning site oligonucleotide
  CDS (1)..(87)
ttgtacaaaaaagcaggcttcgaaggagatagaaccaattctctaaggaaatacttaaccatggtcgactggatccggtaccgaattc

SEQ ID NO: 219 - protein, 29 aa, Artificial Sequence
  Description of Artificial Sequence: Synthetic pENTR11 multiple cloning site peptide
LYKKAGFEGDRTNSLRKYLTMVDWIRYRI

SEQ ID NO: 220 - DNA, 50 bp, Artificial Sequence; identical to SEQ ID NO: 190
  Description of Artificial Sequence: Synthetic pENTR11 multiple cloning site oligonucleotide
  CDS (2)..(49)

SEQ ID NO: 221 - protein, 16 aa, Artificial Sequence
  Description of Artificial Sequence: Synthetic pENTR11 multiple cloning site peptide
NSRPHSRYLDPAFLYK

SEQ ID NO: 222 - DNA, 120 bp, Artificial Sequence
  Description of Artificial Sequence: Synthetic pDEST1 polynucleotide
atgagctgttgacaattaatcatccggctcgtataatgtgtggaattgtgagcggataacaatttcacacaggaaacagacaggtataggatcacaagtttgtacaaaaaagctgaacga

SEQ ID NO: 223 - DNA, 153 bp, Artificial Sequence
  Description of Artificial Sequence: Synthetic pDEST2 polynucleotide
  CDS (94)..(135)
aatattctgaaatgagctgttgacaattaatcatccggtccgtataatctgtggaattgtgagcggataacaatttcacacaggaaacagaccatgtcgtactaccatcaccatcaccatcacggcatcacaagtttgtacaaaaaagctgaa

SEQ ID NO: 224 - protein, 14 aa, Artificial Sequence
  Description of Artificial Sequence: Synthetic pDEST2 peptide
MSYYHHHHHHGITS

SEQ ID NO: 225 - DNA, 153 bp, Artificial Sequence
  Description of Artificial Sequence: Synthetic pDEST3 polynucleotide
  CDS (106)..(120)
cggttctggcaaatattctgaaatgagctgttgacaattaatcatcggctcgtataatgtgtggaattgtgagcggataacaatttcacacaggaaacagtattcatgtcccctatactaggttattggaaaattaagggccttgtgcaaccc

SEQ ID NO: 226 - protein, 5 aa, Artificial Sequence
  Description of Artificial Sequence: Synthetic pDEST3 peptide
MSPIL

SEQ ID NO: 227 - DNA, 102 bp, Artificial Sequence
  Description of Artificial Sequence: Synthetic pDEST3 polynucleotide
  CDS (10)..(63)
ctggttccgcgtggatctcgtcgtgcatctgttggatccccatcaacaagtttgtacaaaaaagctgaacgagaaacgtaaaatgatataaatatcaatata

SEQ ID NO: 228 - protein, 18 aa, Artificial Sequence
  Description of Artificial Sequence: Synthetic pDEST3 peptide
RGSRRASVGSPSTSLYKK

SEQ ID NO: 229 - DNA, 204 bp, Artificial Sequence
  Description of Artificial Sequence: Synthetic pDEST4 polynucleotide
  CDS (97)..(204)
gcaaatattctgaaatgagctgttgacaattaatcatccggtccgtataatctgtggaattgtgagcggataacaatttcacacaggaaacagaccatgggtcatcatcatcatcatcacgattacgatatcccaacgaccgaaaacctgtattttcagggcgcccatatgagcgataaaattattcacctgactgacgacagt

SEQ ID NO: 230 - protein, 36 aa, Artificial Sequence
  Description of Artificial Sequence: Synthetic pDEST4 polypeptide
MGHHHHHHDYDIPTTENLYFQGAHMSDKIIHLTDDS

SEQ ID NO: 231 - DNA, 204 bp, Artificial Sequence
  Description of Artificial Sequence: Synthetic pDEST5 polynucleotide
aggcaccccaggctttacactttatgcttccggctcgtatgttgtgtggaattgtgagcggataacaatttcacacaggaaacagctatgaccatgattacgccaagctctaatacgactcactatagggaaagctggtacgcctgcaggtaccggtccggaattcccgggtcgacgatcacaagtttgtacaaaaaagctgaa

SEQ ID NO: 232 - DNA, 204 bp, Artificial Sequence
  Description of Artificial Sequence: Synthetic pDEST5 polynucleotide
tttacgtttctcgttcagctttcttgtacaaagtggtgatcactagtcggcggccgctctagaggatccaagcttacgtacgcgtgcatgcgacgtcatagctcttctatagtgtcacctaaattcaattcactggccgtcgttttacaacgtcgtgactgggaaaaccctggcgttacccaacttaatcgccttgcagcacat

SEQ ID NO: 233 - DNA, 204 bp, Artificial Sequence
  Description of Artificial Sequence: Synthetic pDEST6 polynucleotide
taacgccagggttttcccagtcacgacgttgtaaaacgacggccagtgaattgaatttaggtgacactatagaagagctatgacgtcgcatgcacgcgtacgtaagcttggatcctctagagcggccgccgactagtgatcacaagtttgtacaaaaaagctgaacgagaaacgtaaaatgatataaatatcaatatattaaat

SEQ ID NO: 234 - DNA, 255 bp, Artificial Sequence
  Description of Artificial Sequence: Synthetic pDEST6 polynucleotide
tatttatatcattttacgtttctcgttcagctttcttgtacaaagtggtgatcgtcgacccgggaattccggaccggtacctgcaggcgtaccagctttccctatagtgagtcgtattagagcttggcgtaatcatggtcatagctgtttcctgtgtgaaattgttatccgctcacaattccacacaacatacgagccggaagcataaagtgtaaagcctggggtgcctaatgagtgagctaactcacattaatt

SEQ ID NO: 235 - DNA, 306 bp, Artificial Sequence
  Description of Artificial Sequence: Synthetic pDEST7 polynucleotide
ccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccggactctagcctaggccgcggagcggataacaatttcacacaggaaacagctatgaccactaggcttttgcaaaaagctatttaggtgacactatagaaggtacgcctgcaggtaccggtccggaattcccatcacaagtttgtacaaaaaagctgaacgagaa

SEQ ID NO: 236 - DNA, 204 bp, Artificial Sequence
  Description of Artificial Sequence: Synthetic pDEST8 polynucleotide
cgtatactccggaatattaatagatcatggagataattaaaatgataaccatctcgcaaataaataagtattttactgttttcgtaacagttttgtaataaaaaaacctataaatattccggattattcataccgtcccaccatcgggcgcggatcatcacaagtttgtacaaaaaagctgaacgagaaacgtaaaatgatata

SEQ ID NO: 237 - DNA, 153 bp, Artificial Sequence
  Description of Artificial Sequence: Synthetic pDEST9 polynucleotide
ttggcgagggacattaaggcgtttaagaaattgagaggacctgttatacacctctacggcggtcctagattggtgcgttaatacacagaattctgattggatcccggtccgaagcgcgctttcccatcaacaagtttgtacaaaaaagctgaa

SEQ ID NO: 238 - DNA, 204 bp, Artificial Sequence
  Description of Artificial Sequence: Synthetic pDEST10 polynucleotide
  CDS (109)..(201)
aaataagtattttactgttttcgtaacagttttgtaataaaaaaacctataaatattccggattattcataccgtcccaccatcgggcgcggatctcggtccgaaaccatgtcgtactaccatcaccatcaccatcacgattacgatatcccaacgaccgaaaacctgtattttcagggcatcacaagtttgtacaaaaaagct

SEQ ID NO: 239 - protein, 31 aa, Artificial Sequence
  Description of Artificial Sequence: Synthetic pDEST10 polypeptide
MSYYHHHHHHDYDIPTTENLYFQGITSLYKK

SEQ ID NO: 240 - DNA, 204 bp, Artificial Sequence
  Description of Artificial Sequence: Synthetic pDEST11 polynucleotide
tagtgaaccgtcagatcgcctggagacgccatccacgctgttttgacctccatagaagacaccgggaccgatccagcctccgcggccccgaattcgagctcggtacccggggatcctctagagtcgaggtcgacggtatcgataagcttgatatcaacaagtttgtacaaaaaagctgaacgagaaacgtaaaatgatataaat

SEQ ID NO: 241 - DNA, 255 bp, Artificial Sequence
  Description of Artificial Sequence: Synthetic pDEST12.2 polynucleotide
accgtcagatcgcctggagacgccatccacgctgttttgacctccatagaagacaccgggaccgatccagcctccggactctagcctaggccgcggagcggataacaatttcacacaggaaacagctatgaccattaggcctttgcaaaaagctatttaggtgacactatagaaggtacgcctgcaggtaccggtccggaattcccatcaacaagtttgtacaaaaaagctgaacgagaaacgtaaaatgatata

SEQ ID NO: 242 - DNA, 300 bp, Artificial Sequence
  Description of Artificial Sequence: Synthetic pDEST13 polynucleotide
tgggcaaaccaagacagctaaagatctctcacctaccaaacaatgcccccctgcaaaaaataaattcatataaaaaacatacagataaccatctgcggtgataaattatctctggcggtgttgacataaataccactggcggtgatactgagcacatcagcaggacgcactgaccaccatgaaggtgacgctcttaaaaattaagccctgaagaagggcagcattcaaagcagaaggctttggggtgtgtgatacgaaacgaagcattgggatcatcacaagtttgtacaaaaaagctga

SEQ ID NO: 243 - DNA, 120 bp, Artificial Sequence
  Description of Artificial Sequence: Synthetic pDEST14 polynucleotide
tgccggccacgatgcgtccggcgtagaggatcgagatctcgatcccgcgaaattaatacgactcactatagggagaccacaacggtttccctctagatcacaagtttgtacaaaaaagct

SEQ ID NO: 244 - DNA, 204 bp, Artificial Sequence
  Description of Artificial Sequence: Synthetic pDEST15 polynucleotide
  modified_base (1)..(1): a, c, t, g, unknown or other
  CDS (106)..(120)
natcgagatctcgatcccgcgaaattaatacgactcactatagggagaccacaacggtttccctctagaaataattttgtttaactttaagaaggagatatacatatgtcccctatactaggttattggaaaattaagggccttgtgcaacccactcgacttcttttggaatatcttgaagaaaaatatgaagagcatttgtat

SEQ ID NO: 245 - protein, 5 aa, Artificial Sequence
  Description of Artificial Sequence: Synthetic pDEST15 peptide
MSPIL

SEQ ID NO: 246 - DNA, 153 bp, Artificial Sequence
  Description of Artificial Sequence: Synthetic pDEST15 polynucleotide
  CDS (70)..(99)
cagggctggcaagccacgtttggtggtggcgaccatcctccaaaatcggatctggttccgcgtccatggtcgaatcaaacaagtttgtacaaaaaagctgaacgagaaacgtaaaatgatataaatatcaatatattaaattagattttgcat

SEQ ID NO: 247 - protein, 10 aa, Artificial Sequence
  Description of Artificial Sequence: Synthetic pDEST15 peptide
SNQTSLYKKA

SEQ ID NO: 248 - DNA, 153 bp, Artificial Sequence
  Description of Artificial Sequence: Synthetic pDEST16 multiple cloning site polynucleotide
  CDS (100)..(111)
gatctcgatcccgcgaaattaatacgactcactatagggagaccacaacggtttccctctagaaataattttgtttaactttaagaaggagatatacatatgagcgataaaattattcacctgactgacgacagttttgacacggatgtactc

SEQ ID NO: 249 - protein, 4 aa, Artificial Sequence
  Description of Artificial Sequence: Synthetic pDEST16 multiple cloning site peptide
MSDK

SEQ ID NO: 250 - DNA, 153 bp, Artificial Sequence
  Description of Artificial Sequence: Synthetic pDEST16 multiple cloning site polynucleotide
  CDS (82)..(123)
gtggcggcaaccaaagtgggtgcactgtctaaaggtcagttgaaagagttcctcgacgctaacctggccggttctggttctggtgatgacgatgacaagatcacaagtttgtacaaaaaagctgaacgagaaacgtaaaatgatataaatatc

SEQ ID NO: 251 - protein, 14 aa, Artificial Sequence
  Description of Artificial Sequence: Synthetic pDEST16 multiple cloning site peptide
GDDDDKITSLYKKA

SEQ ID NO: 252 - DNA, 153 bp, Artificial Sequence
  Description of Artificial Sequence: Synthetic pDEST17 multiple cloning site polynucleotide
  CDS (94)..(153)
gatcccgcgaaattaatacgactcactatagggagaccacaacggtttccctctagaaataattttgtttaactttaagaaggagatatacatatgtcgtactaccatcaccatcaccatcacctcgaatcaacaagtttgtacaaaaaagct

SEQ ID NO: 253 - protein, 20 aa, Artificial Sequence
  Description of Artificial Sequence: Synthetic pDEST17 multiple cloning site peptide
MSYYHHHHHHLESTSLYKKA

SEQ ID NO: 254 - DNA, 420 bp, Artificial Sequence
  Description of Artificial Sequence: Synthetic pDEST18 p10 Promoter polynucleotide
gaagacctcggccgtcgcggcgcttgccggtggtgctgaccccggatgaagtggttcgcatcctcggttttctggaaggcgagcatcgtttgttcgcccaggactctagctatagttctagtggttggctacgtatcgagcaagaaaataaaacgccaaacgcgttggagtcttgtgtgctatttttacaaagattcagaaatacgcatcacttacaacaagggggactatgaaattatgcattttgaggatgccgggacctttaattcaacccaacacaatatattatagttaaataagaattatttatcaaatcatttgtatattaattaaaatactatactgtaaattacattttatttacaatgaggatcatcacaagtttgtacaaaaaagctgaacgagaaacgtaaaatgata

SEQ ID NO: 255 - DNA, 300 bp, Artificial Sequence
  Description of Artificial Sequence: Synthetic pDEST19 39K Promoter polynucleotide
ggtgacgccgtcatctttccattgtaacgtaaatggcaacttgtagatgaacgcgctgtcaaaaaaccggccagtttcttccacaaactcgcgcacggctgtctcgtaaacttttgcgtcgcaacaatcgcgatgacctcgtggtatggaaattttttctaaaaaagtgtcgttcatgtcggcggcggcgttcgcgctccggtacgcgcgacgggcacacagcaggacagccttgtccggctcgattatcataaacaatcctgcaggcatgcaagctggatcatcacaagtttgtacaaa

SEQ ID NO: 256 - DNA, 204 bp, Artificial Sequence
  Description of Artificial Sequence: Synthetic pDEST20 Polyhedron Promoter polynucleotide
  CDS (163)..(174)
ggctacgtatactccggaatattaatagatcatggagataattaaaatgataaccatctcgcaaataaataagtattttactgttttcgtaacagttttgtaataaaaaaacctataaatattccggattattcataccgtcccaccatcgggcgcggatccatggcccctatactaggttattggaaaattaagggccttgtg

SEQ ID NO: 257 - protein, 4 aa, Artificial Sequence
  Description of Artificial Sequence: Synthetic pDEST20 Polyhedron Promoter peptide
MAPI

SEQ ID NO: 258 - DNA, 95 bp, Artificial Sequence
  Description of Artificial Sequence: Synthetic pDEST20 Polyhedron Promoter oligonucleotide
  CDS (1)..(48)
tcggatctggttccgcgtcataatcaaacaagtttgtacaaaaaagctgaacgagaaacgtaaaatgatataaatatcaatatattaaattagat

SEQ ID NO: 259 - protein, 16 aa, Artificial Sequence
  Description of Artificial Sequence: Synthetic pDEST20 Polyhedron Promoter peptide
SDLVPRHNQTSLYKKA

SEQ ID NO: 260 - DNA, 204 bp, Artificial Sequence
  Description of Artificial Sequence: Synthetic pDEST21 Promoter region polynucleotide
  CDS (163)..(180)
ttgccgctttgctatcaagtataaatagacctgcaattattaatcttttgtttcctcgtcattgttctcgttccctttcttccttgtttctttttctgcacaatatttcaagctataccaagcatacaatcaactccaagcttgaagcaagcctcctgaaagatgaagctactgtcttctatcgaacaagcatgcgatatttgc

SEQ ID NO: 261 - protein, 6 aa, Artificial Sequence
  Description of Artificial Sequence: Synthetic pDEST21 Promoter region peptide
MKLLSS

SEQ ID NO: 262 - DNA, 102 bp, Artificial Sequence
  Description of Artificial Sequence: Synthetic pDEST21 Promoter region polynucleotide
  CDS (37)..(78)
gaagagagtagtaacaaaggtcaaagacagttgactgtatcgtcgaggtcgaatcaaacaagtttgtacaaaaaagctgaacgagaaacgtaaaatgatata

SEQ ID NO: 263 - protein, 14 aa, Artificial Sequence
  Description of Artificial Sequence: Synthetic pDEST21 Promoter region peptide
VSSRSNQTSLYKKA

SEQ ID NO: 264 - DNA, 255 bp, Artificial Sequence
  Description of Artificial Sequence: Synthetic pDEST22 Promoter region polynucleotide
  CDS (217)..(228)
acgcacactactctctaatgagcaacggtatacggccttccttccagttacttgaatttgaaataaaaaaagtttgccgctttgctatcaagtataaatagacctgcaattattaatcttttgtttcctcgtcattgttctcgttccctttcttccttgtttctttttctgcacaatatttcaagctataccaagcatacaatcaactccaagcttatgcccaagaagaagcggaaggtctcgagcggcgccaat

SEQ ID NO: 265 - protein, 4 aa, Artificial Sequence
  Description of Artificial Sequence: Synthetic pDEST22 Promoter region peptide
MPKK

SEQ ID NO: 266 - DNA, 82 bp, Artificial Sequence
  Description of Artificial Sequence: Synthetic pDEST22 oligonucleotide
  CDS (28)..(66)
gaagataccccaccaaacccaaaaaaagagggtgggtcgaatcaaacaagtttgtacaaaaaagctgaacgagaaacgtaaa

SEQ ID NO: 267 - protein, 13 aa, Artificial Sequence
  Description of Artificial Sequence: Synthetic pDEST22 peptide
EGGSNQTSLYKKA

SEQ ID NO: 268 - DNA, 102 bp, Artificial Sequence
  Description of Artificial Sequence: Synthetic pDEST23 T7 promoter polynucleotide
atcccgcgaaattaatacgactcactatagggagaccacaacggtttccctctagatcacaagtttgtacaaaaaagctgaacgagaaacgtaaaatgatat

SEQ ID NO: 269 - DNA, 153 bp, Artificial Sequence
  Description of Artificial Sequence: Synthetic pDEST23 T7 promoter polynucleotide
  CDS (61)..(126)
tttttatgcaaaatctaatttaatatattgatatttatatcattttacgtttctcgttcagctttcttgtacaaagtggtgattatgtcgtactaccatcaccatcaccatcacctcgatgagcaataactagcataaccccttggggcctct

SEQ ID NO: 270 - protein, 22 aa, Artificial Sequence
  Description of Artificial Sequence: Synthetic pDEST23 T7 promoter peptide
AFLYKVVIMSYYHHHHHHLDEQ

SEQ ID NO: 271 - DNA, 102 bp, Artificial Sequence
  Description of Artificial Sequence: Synthetic pDEST24 T7 promoter polynucleotide
atcgagatctcgatcccgcgaaattaatacgactcactatagggagaccacaacggtttccctctagatcacaagtttgtacaaaaaagctgaacgagaaac

SEQ ID NO: 272 - DNA, 102 bp, Artificial Sequence
  Description of Artificial Sequence: Synthetic pDEST24 T7 promoter polynucleotide
  CDS (22)..(60)
tcattttacgtttctcgttcagctttcttgtacaaagtggtgattatgtcccctatactaggttattggaaaattaagggccttgtgcaacccactcgactt

SEQ ID NO: 273 - protein, 13 aa, Artificial Sequence
  Description of Artificial Sequence: Synthetic pDEST24 T7 promoter peptide
AFLYKVVIMSPIL

SEQ ID NO: 274 - DNA, 102 bp, Artificial Sequence
  Description of Artificial Sequence: Synthetic pDEST25 T7 promoter polynucleotide
  modified_base (1)..(1): a, c, t, g, unknown or other
nagatctcgatcccgcgaaattaatacgactcactatagggagaccacaacggtttccctctagatcacaagtttgtacaaaaaagctgaacgagaaacgta

SEQ ID NO: 275 - DNA, 102 bp, Artificial Sequence
  Description of Artificial Sequence: Synthetic pDEST25 T7 promoter polynucleotide
  CDS (19)..(60)
ttttacgtttctcgttcagctttcttgtacaaagtggtgattatgagcgataaaattattcacctgactgacgacagttttgacacggatgtactcaaagcg

SEQ ID NO: 276 - protein, 14 aa, Artificial Sequence
  Description of Artificial Sequence: Synthetic pDEST25 T7 promoter peptide
AFLYKVVIMSDKII

SEQ ID NO: 277 - DNA, 306 bp, Artificial Sequence
  Description of Artificial Sequence: Synthetic pDEST26 CMV promoter polynucleotide
  CDS (238)..(297)
ttgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccggactctagcctaggccgcggaccatggcgtactaccatcaccatcaccatcactctagatcaacaagtttgtacaaaaaagctgaacgagaa

SEQ ID NO: 278 - protein, 20 aa, Artificial Sequence
  Description of Artificial Sequence: Synthetic pDEST26 CMV promoter peptide
MAYYHHHHHHSRSTSLYKKA

SEQ ID NO: 279 - DNA, 255 bp, Artificial Sequence
  Description of Artificial Sequence: Synthetic pDEST27 promoter polynucleotide
  modified_base (1)..(1): a, c, t, g, unknown or other
  CDS (139)..(153)
nacggtgggaggtctatataagcagagctcgtttagtgaaccgtcagatcgcctggagacgccatccacgctgttttgacctccatagaagacaccgggaccgatccagcctccggactctagcctaggccgcggaccatggcccctatactaggttattggaaaattaagggccttgtgcaacccactcgacttcttttggaatatcttgaagaaaaatatgaagagcatttgtatgagcgcgatgaaggtgat

SEQ ID NO: 280 - protein, 5 aa, Artificial Sequence
  Description of Artificial Sequence: Synthetic pDEST27 promoter peptide
MAPIL

SEQ ID NO: 281 - DNA, 87 bp, Artificial Sequence
  Description of Artificial Sequence: Synthetic pDEST27 promoter oligonucleotide
  CDS (37)..(75)
tttggtggtggcgaccatcctccaaaatcggatctggttccgcgttctagatcaacaagtttgtacaaaaaagctgaacgagaaacg

SEQ ID NO: 282 - protein, 13 aa, Artificial Sequence
  Description of Artificial Sequence: Synthetic pDEST27 promoter peptide
VPRSRSTSLYKKA

SEQ ID NO: 283 - DNA, 405 bp, Artificial Sequence
  Description of Artificial Sequence: Synthetic pEXP501 polynucleotide
agagctcgtttagtgaaccgtcagatcgcctggagacgccatccacgctgttttgacctccatagaagacaccgggaccgatccagcctccggactctagcctaggccgcggagcggataacaatttcacacaggaaacagctatgaccattaggcctatttaggtgacactatagaacaagtttgtacaaaaaagcaggctggtaccggtccggaattcccgggatatcgtcgacgagctcactagtcggcggccgctctagagtatccctcgaggggcccaagcttacgcgtacccagctttcttgtacaaagtggtccctatagtgagtcgtattataagctaggcactggccgtcgttttacaacgtcgtgactgggaaaactgctagcttgggatctttg

SEQ ID NO: 284 - DNA, 153 bp, Artificial Sequence
  Description of Artificial Sequence: Synthetic His6-CAT polynucleotide
  CDS (31)..(153)
cggataacaatttcacacaggaaacagaccatgtcgtactaccatcaccatcaccatcacggcatcacaagtttgtacaaaaaagcaggctttgaaaacctgtattttcaaggaaccatggagaaaaaaatcactggatataccaccgttgat

SEQ ID NO: 285 - protein, 41 aa, Artificial Sequence
  Description of Artificial Sequence: Synthetic His6-CAT polypeptide
MSYYHHHHHHGITSLYKKAGFENLYFQGTMEKKITGYTTVD

SEQ ID NO: 286 - DNA, 10 bp, Artificial Sequence
  Description of Artificial Sequence: Synthetic consensus oligonucleotide
magtcactat

SEQ ID NO: 287 - DNA, 23 bp, Artificial Sequence
  Description of Artificial Sequence: Synthetic attB1- and attB2-derived primer
  modified_base (10)..(23): a, c, t, g, unknown or other
aagcaggctnnnnnnnnnnnnnn

SEQ ID NO: 288 - DNA, 23 bp, Artificial Sequence
  Description of Artificial Sequence: Synthetic attB1- and attB2-derived primer
  modified_base (10)..(23): a, c, t, g, unknown or other
aagctgggtnnnnnnnnnnnnnn

SEQ ID NO: 289 - DNA, 22 bp, Artificial Sequence
  Description of Artificial Sequence: Synthetic attB1- and attB2-derived primer
  modified_base (9)..(22): a, c, t, g, unknown or other
agcaggctnnnnnnnnnnnnnn

SEQ ID NO: 290 - DNA, 22 bp, Artificial Sequence
  Description of Artificial Sequence: Synthetic attB1- and attB2-derived primer
  modified_base (9)..(22): a, c, t, g, unknown or other
agctgggtnnnnnnnnnnnnnn

SEQ ID NO: 291 - DNA, 21 bp, Artificial Sequence
  Description of Artificial Sequence: Synthetic attB1- and attB2-derived primer
  modified_base (8)..(21): a, c, t, g, unknown or other
gcaggctnnnnnnnnnnnnnn

SEQ ID NO: 292 - DNA, 21 bp, Artificial Sequence
  Description of Artificial Sequence: Synthetic attB1- and attB2-derived primer
  modified_base (8)..(21): a, c, t, g, unknown or other
gctgggtnnnnnnnnnnnnnn

SEQ ID NO: 293 - DNA, 20 bp, Artificial Sequence
  Description of Artificial Sequence: Synthetic attB1- and attB2-derived primer
  modified_base (7)..(20): a, c, t, g, unknown or other
caggctnnnnnnnnnnnnnn

SEQ ID NO: 294 - DNA, 20 bp, Artificial Sequence
  Description of Artificial Sequence: Synthetic attB1- and attB2-derived primer
  modified_base (7)..(20): a, c, t, g, unknown or other
ctgggtnnnnnnnnnnnnnn

SEQ ID NO: 295 - DNA, 10 bp, Unknown
  Description of Unknown: Eukaryotic initiating oligonucleotide
gccaccatgg

SEQ ID NO: 296 - DNA, 16 bp, Artificial Sequence
  Description of Artificial Sequence: Synthetic oligonucleotide
  modified_base (4)..(12): a, c, t, g, unknown or other
atgnnnnnnnnntaac

SEQ ID NO: 297 - DNA, 20 bp, Artificial Sequence
  Description of Artificial Sequence: Synthetic oligonucleotide
  modified_base (9)..(17): a, c, t, g, unknown or other
tcgagttannnnnnnnncat

SEQ ID NO: 298 - DNA, 30 bp, Artificial Sequence
  Description of Artificial Sequence: Synthetic oligonucleotide
  modified_base (1)..(3): a, c, t, g, unknown or other
  CDS (4)..(27)
  modified_base (29)..(30): a, c, t, g, unknown or other
nnnacaagtttgtacaaaaaagcaggctnn

SEQ ID NO: 299 - protein, 8 aa, Artificial Sequence
  Description of Artificial Sequence: Synthetic peptide
TSLYKKAG

SEQ ID NO: 300 - DNA, 33 bp, Artificial Sequence
  Description of Artificial Sequence: Synthetic oligonucleotide
  modified_base (1)..(4): a, c, t, g, unknown or other
  CDS (7)..(30)
  modified_base (30)..(33): a, c, t, g, unknown or other
nnnnacccagctttcttgtacaaagtggtnnnn

SEQ ID NO: 301 - protein, 8 aa, Artificial Sequence
  Description of Artificial Sequence: Synthetic peptide
PAFLYKVV

SEQ ID NO: 302 - DNA, 51 bp, Artificial Sequence
  Description of Artificial Sequence: Synthetic oligonucleotide
  CDS (1)..(42)
gatgacgatgacaaggtacccatcacaagtttgtacaaaaaagctgaacga

SEQ ID NO: 303 - protein, 14 aa, Artificial Sequence
  Description of Artificial Sequence: Synthetic peptide
DDDDKVPITSLYKK

What is claimed is:

1. An isolated nucleic acid segment, comprising, in order, the following components:
   a) a first site-specific recombination site,
   b) a ccdB gene,
   c) a nucleic acid region encoding the amino acid sequence encoded by nucleotides 1426-1510 of SEQ ID No. 129, and
   d) a second site-specific recombination site.

2. The nucleic acid segment of claim 1, wherein the first or second site-specific recombination sites are att sites.

3. The nucleic acid segment of claim 1, wherein the first and second site-specific recombination sites do not recombine with each other.

4. The nucleic acid segment of claim 1, wherein the nucleic acid segment is a linear nucleic acid molecule.

5. A vector including the isolated nucleic acid segment of claim 1.

6. The nucleic acid segment of claim 1, wherein the nucleic acid segment additionally contains an antibiotic resistance marker between the first and second site-specific recombination sites.

7. An isolated cloning vector comprising the following components:
   a) a first site-specific recombination site,
   b) a ccdB gene,
   c) a nucleic acid region encoding the amino acid sequence encoded by nucleotides 1426-1510 of SEQ ID No. 129, and
   d) a second site-specific recombination site.

8. The cloning vector of claim 7 which is a plasmid.

9. The plasmid cloning vector of claim 8, further comprising a prokaryotic origin of replication and a eukaryotic promoter.

10. The plasmid cloning vector of claim 8, wherein the first or second site-specific recombination sites are att sites.

11. The plasmid cloning vector of claim 8, wherein the first and second site-specific recombination sites do not recombine with each other.

* * * * *